US012680099B2

(12) United States Patent
Keating et al.

(10) Patent No.: US 12,680,099 B2
(45) Date of Patent: Jul. 14, 2026

(54) COMPLEMENT COMPONENT C3 iRNA COMPOSITIONS AND METHODS OF USE THEREOF FOR TREATING OR PREVENTING COMPLEMENT COMPONENT C3-ASSOCIATED DISEASES

(71) Applicant: Alnylam Pharmaceuticals, Inc., Cambridge, MA (US)

(72) Inventors: Mark Keating, Weston, MA (US); James D. McIninch, Burlington, MA (US)

(73) Assignee: Alnylam Pharmaceuticals, Inc., Cambridge, MA (US)

(*) Notice: Subject to any disclaimer, the term of this patent is extended or adjusted under 35 U.S.C. 154(b) by 833 days.

(21) Appl. No.: 17/900,919

(22) Filed: Sep. 1, 2022

(65) Prior Publication Data

US 2023/0272382 A1 Aug. 31, 2023

Related U.S. Application Data

(63) Continuation of application No. PCT/US2021/020777, filed on Mar. 4, 2021.

(60) Provisional application No. 62/985,482, filed on Mar. 5, 2020, provisional application No. 62/985,484, filed on Mar. 5, 2020.

(51) Int. Cl.

| | |
|---|---|
| ***C07H 21/02*** | (2006.01) |
| ***C07H 21/04*** | (2006.01) |
| ***C12N 15/113*** | (2010.01) |

(52) U.S. Cl.

CPC ........ *C12N 15/113* (2013.01); *C12N 2310/14* (2013.01); *C12N 2310/315* (2013.01); *C12N 2310/321* (2013.01); *C12N 2310/3515* (2013.01)

(58) Field of Classification Search

CPC .......................... C12N 15/113; C12N 2310/14

See application file for complete search history.

(56) References Cited

U.S. PATENT DOCUMENTS

| | | | |
|---|---|---|---|
| 10,465,194 | B2 | 11/2019 | Borodovsky et al. |
| 11,186,842 | B2 | 11/2021 | Borodovsky et al. |
| 11,866,701 | B2 | 1/2024 | Hinkle et al. |
| 11,965,166 | B2 | 4/2024 | McIninch et al. |
| 12,258,565 | B2 | 3/2025 | Keating et al. |
| 12,365,896 | B2 | 7/2025 | Keating et al. |
| 2003/0096775 | A1 | 5/2003 | Graham et al. |
| 2007/0088154 | A1 | 4/2007 | Khvorova et al. |
| 2007/0123484 | A1 | 5/2007 | Bhat |
| 2008/0113351 | A1 | 5/2008 | Naito et al. |
| 2009/0239814 | A1 | 9/2009 | Manoharan et al. |
| 2009/0306178 | A1 | 12/2009 | Bhat et al. |
| 2013/0217756 | A1 | 8/2013 | Cancilla et al. |
| 2013/0281511 | A1 | 10/2013 | Bettencourt et al. |
| 2016/0222389 | A1 | 8/2016 | Grossman |
| 2017/0159055 | A1 | 6/2017 | Prakash et al. |
| 2020/0263183 | A1 | 8/2020 | Borodovsky et al. |
| 2020/0339998 | A1 | 10/2020 | Borodovsky et al. |
| 2022/0213486 | A1 | 7/2022 | Borodovsky et al. |
| 2022/0364088 | A1 | 11/2022 | Keating et al. |
| 2023/0257749 | A1 | 8/2023 | McIninch et al. |
| 2023/0272382 | A1 | 8/2023 | Keating et al. |
| 2024/0018515 | A1 | 1/2024 | McIninch et al. |
| 2024/0209369 | A1 | 6/2024 | Keating et al. |
| 2024/0294912 | A1 | 9/2024 | Hinkle et al. |
| 2024/0376477 | A1 | 11/2024 | Borodovsky et al. |
| 2025/0019698 | A1 | 1/2025 | Barry |
| 2025/0027080 | A1 | 1/2025 | McIninch et al. |

FOREIGN PATENT DOCUMENTS

| | | | |
|---|---|---|---|
| EP | 1752536 | A1 | 2/2007 |
| WO | WO-2003/066805 | A2 | 8/2003 |
| WO | WO-2006/047673 | A2 | 5/2006 |
| WO | WO-2007/064846 | A2 | 6/2007 |
| WO | WO-2007/089375 | A2 | 8/2007 |
| WO | WO-2008/036841 | A2 | 3/2008 |
| WO | WO-2010/048352 | A2 | 4/2010 |
| WO | WO-2012/037254 | A1 | 3/2012 |
| WO | WO-2013/067076 | A2 | 5/2013 |
| WO | WO-2013074974 | A2 | 5/2013 |
| WO | WO-2014/107763 | A1 | 7/2014 |
| WO | WO-2015/038939 | A2 | 3/2015 |
| WO | WO-2015/089368 | A2 | 6/2015 |
| WO | WO-2015/168635 | A2 | 11/2015 |
| WO | WO-2017/040078 | A1 | 3/2017 |
| WO | WO-2018/075373 | A1 | 4/2018 |
| WO | WO-2019/027015 | A1 | 2/2019 |
| WO | WO-2019/089922 | A1 | 5/2019 |
| WO | WO-2019/217459 | A1 | 11/2019 |
| WO | WO-2019/222479 | A1 | 11/2019 |
| WO | WO-2020/104669 | A1 | 5/2020 |

(Continued)

OTHER PUBLICATIONS

Elbashir et al. (The EMBO Journal, vol. 20, No. 23, pp. 6877-6888, 2001).*

Parrish et al. (Molecular Cell, vol. 6, 1077-1087, Nov. 2000).*

Fujita et al. (Int. J. Mol. Sci. 2015, 16, 5254-5270).*

Bora et al., Complement activation via alternative pathway is critical in the development of laser-induced choroidal neovascularization: role of factor B and factor H. J Immunol. Aug. 1, 2006;177(3):1872-8.

Borodovsky et al., Development of RNAi Therapeutics Targeting the Complement Pathway. Blood. 2013;122(21)2471.

Cheng et al., [Effect of C5-siRNA silencing receptor C5 on myocardial ischemia injury in rats]. Nan Fang Yi Ke Da Xue Xue Bao. Jun. 2010;30(6):1486-8.

(Continued)

*Primary Examiner* — Amy Rose Hudson

(74) *Attorney, Agent, or Firm* — McCarter & English, LLP; Maria Laccotripe Zacharakis; Joseph A. Ciardi

(57) ABSTRACT

The present invention provides iRNA agents, e.g., double stranded iRNA agents, that target the complement component C3 gene and methods of using such iRNA agents for treating or preventing C3-associated ocular diseases or C3-associated neurodegenerative diseases.

18 Claims, 1 Drawing Sheet

Specification includes a Sequence Listing.

(56) References Cited

FOREIGN PATENT DOCUMENTS

| | | | |
|---|---|---|---|
| WO | WO-2021/081026 | A1 | 4/2021 |
| WO | WO-2021/178607 | A1 | 9/2021 |
| WO | WO-2021/222549 | A1 | 11/2021 |
| WO | WO-2023/044370 | A2 | 3/2023 |
| WO | WO-2023/076451 | A1 | 5/2023 |

OTHER PUBLICATIONS

International Search Report and Written Opinion for Application No. PCT/US2014/069951, dated Jul. 6, 2015.

Zheng et al., "Preventing Renal Ischemia-Reperfusion Injury Using Small Interfering RNA by Targeting Complement 3 Gene," American Journal of Transplantation 2006; 6: 2099-2108.

Zheng et al., "Protection of Renal Ischemia Injury using Combination Gene Silencing of Complement 3 and Caspase 3 Genes," Transplantation 2006;82: 1781-1786.

Reynolds et al., Rational siRNA design for RNA interference. Nat Biotechnol. Mar. 2004;22(3):326-30.

International Search Report and Written Opinion from PCT/US2018/058705, mailed on Mar. 1, 2019.

International Search Report and Written Opinion from PCT/US2020/056563, mailed on Mar. 22, 2021.

International Search Report and Written Opinion from PCT/US2021/020777, mailed on Aug. 16, 2021.

Vickers et al., Efficient reduction of target RNAs by small interfering RNA and RNase H-dependent antisense agents. A comparative analysis. J Biol Chem. Feb. 28, 2003;278(9):7108-18.

Watts et al., "Gene silencing by siRNAs and antisense oligonucleotides in the laboratory and the clinic", J Pathol 2012; 226: 365-379.

Wang et al., "Protecting neurons from cerebral ischemia/reperfusion injury via nanoparticle-mediated delivery of an siRNA to inhibit microglial neurotoxicity", Biomaterials 161 (2018) 95-105.

Ricklin et al., "Complement component C3—The "Swiss Army Knife" of innate immunity and host defense", Immunol Rev. Nov. 2016: 274(1): 33-58.

Riihila, et al. "Complement Component C3 and Complement Factor B Promote Growth of Cutaneous Squamous Cell Carcinoma" Am. J. Path. 187(5):1186-1197, 2017.

International Preliminary Report on Patentability from PCT/US2022/047987, mailed May 10, 2024.

Foster et al., "Advanced siRNA Designs Further Improve In Vivo Performance of GalNAc-siRNA Conjugates", Mol Ther. Mar. 7, 2018;26(3):708-717.

Ui-Tei et al., "Functional dissection of siRNA sequence by systematic DNA substitution: modified siRNA with a DNA seed arm is a powerful tool for mammalian gene silencing with significantly reduced off-target effect", Nucleic Acids Res. Apr. 2008;36(7):2136-51.

Chernikov et al., "Current Development of siRNA Bioconjugates: From Research to the Clinic", Front Pharmacol. Apr. 26, 2019:10:444.

Hu et al., "Therapeutic siRNA: state of the art", Signal Transduction and Targeted Therapy (2020) 5:101.

Nair et al., "Impact of enhanced metabolic stability on pharmacokinetics and pharmacodynamics of GalNAc-siRNA conjugates", Nucleic Acids Res.Nov. 2, 2017;45(19):10969-10977.

Shukla et al., "Exploring Chemical Modifications for siRNA Therapeutics:A Structural and Functional Outlook", ChemMedChem. Mar. 1, 2010;5(3):328-49.

Nair et al. "Multivalent N-Acetylgalactosamine-Conjugated siRNA Localizes in Hepatocytes and Elicits Robust RNAi-Mediated Gene Silencing" J. Am. Chem. Soc. 2014, 136, 16958-16961.

International Preliminary Report on Patentability from PCT/US2021/020777, mailed Sep. 15, 2022.

* cited by examiner

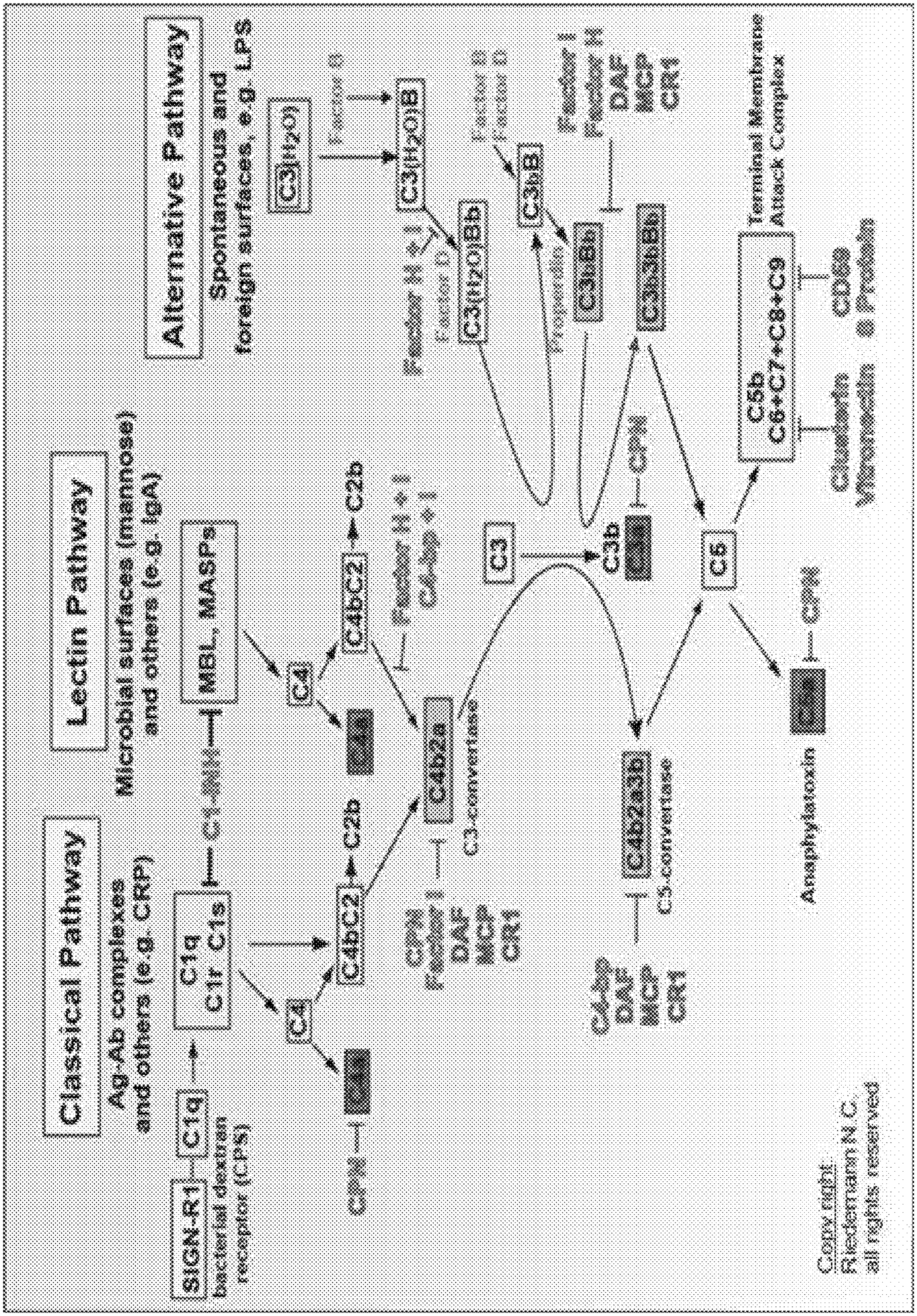

Classical Pathway
Ag-Ab complexes and others (e.g. CRP)
Lectin Pathway
Microbial surfaces (mannose) and others (e.g. IgA)
Alternative Pathway
Spontaneous and foreign surfaces, e.g. LPS
SIGN-R1
C1q
bacterial dextran receptor (CPS)
C1q
C1r C1s
MBL, MASPs
C4
C4bC2
C2b
C4b2a
C3-convertase
CPN
Factor I
DAF
MCP
CR1
Factor H + I
C4-bp + I
C3
C3b
C4b2a3b
C5-convertase
C4-bp
DAF
MCP
CR1
C5
Anaphylatoxin
C5b
C6+C7+C8+C9
Terminal Membrane Attack Complex
Clusterin
Vitronectin
CD59
S Protein
C3(H2O)
C3(H2O)B
C3(H2O)Bb
Factor B
Factor D
Factor H + I
C3bB
C3bBb
Properdin
Factor I
Factor H
DAF
MCP
CR1
Copy right:
Riedemann N.C.
all rights reserved

COMPLEMENT COMPONENT C3 iRNA COMPOSITIONS AND METHODS OF USE THEREOF FOR TREATING OR PREVENTING COMPLEMENT COMPONENT C3-ASSOCIATED DISEASES

RELATED APPLICATIONS

This application is a 35 § U.S.C. 111(a) continuation application which claims the benefit of priority to PCT/US2021/020777, filed on Mar. 4, 2021, which claims the benefit of priority to U.S. Provisional Application No. 62/985,482, filed on Mar. 5, 2020, and U.S. Provisional Application No. 62/985,484, filed on Mar. 5, 2020. The entire contents of each of the foregoing applications are incorporated herein by reference.

SEQUENCE LISTING

The instant application contains a Sequence Listing which has been submitted electronically in XML file format and is hereby incorporated by reference in its entirety. Said XML copy, created on Apr. 25, 2023, is named 121301-11802_SL.xml and is 9,962,565 bytes in size.

BACKGROUND OF THE INVENTION

The complement system consists of more than 30 proteins that are either present as soluble proteins in the blood or are present as membrane-associated proteins. Activation of complement leads to a sequential cascade of enzymatic reactions, known as complement activation pathways resulting in the formation of the potent anaphylatoxins C3a and C5a. Initially, complement was thought to play a major role in innate immunity where a robust and rapid response is mounted against invading pathogens. However, recently it is becoming increasingly evident that complement also plays an important role in adaptive immunity involving T and B cells that help in elimination of pathogens (Dunkelberger J R and Song W C. (2010) *Cell Res.* 20:34; Molina H, et al. (1996) *Proc Natl Acad Sci USA.* 93:3357), in maintaining immunologic memory preventing pathogenic re-invasion, and is involved in numerous human pathological states (Qu, H, et al. (2009) *Mol Immunol.* 47:185; Wagner, E. and Frank M M. (2010) *Nat Rev Drug Discov.* 9:43).

Complement activation is known to occur through three different pathways that converge at cleavage of C3 into C3a and C3b: alternate, classical and lectin (FIG. 1) involving proteins that mostly exist as inactive zymogens that are then sequentially cleaved and activated.

The alternate pathway is activated by the binding of C3b, which is spontaneously generated by the hydrolysis of C3, on targeted surfaces. This surface-bound C3b is then recognized by factor B, forming the complex C3bB. The C3bB complex, in turn, is cleaved by factor D to yield the active form of the C3 convertase of the AP (C3bBb). Both types of C3 convertases will cleave C3, forming C3b. C3b then either binds to more factor B, enhancing the complement activation through the AP (the so-called alternative or amplification loop), or leads to the formation of the active C5 convertase (C3bBbC3b or C4bC2bC3b), which cleaves C5 and triggers the late events that result in the formation of the membrane attack complex (MAC) (C5b-9).

Inappropriate activation of the complement system is responsible for propagating or initiating pathology in many different diseases including ocular diseases, such as age-related macular degeneration (AMD), e.g., dry AMB and wet AMD, basal laminar drusen (BLD), diabetic retinopathy (DR), diabetic macular edema (DME) and retinal vein occlusion (RVO).

For example, it has been shown that over-active inflammatory responses mediated by C3 lead to the death of functional ocular cells. (Inafuku, S. et al (2018) *Front Mol Neurosci* 11:278). (Natoli, R. et al (2017) *Invest Ophthalmol Vis Sci* 58(7): 2977-2990). It has also been shown that drusen deposits contain C3 in AMD and BSD lesions. (Coffree, P. J. et al (2007) *PNAS* 104(2) 16651-16656). and fragment C3a of C3 has been shown to accumulate in drusen and upregulate the secretion of the vascular endothelial growth factor (VEGF) by human retinal pigment epithelial (RPE) cells both in vitro and in vivo, promoting sprouting of new vessels (see Nozaki, M. et al (2006) *PNAS* 103(7): 2328-2333).

Treatments for these ocular diseases include anti-VEGF to reduce neovascularization, focal laser treatment to seal vessels in edema or burn drusen deposits, and corticosteroids to decrease inflammation. However, these treatments are not fully effective, are invasive and can result in serous side effects, such as development of cataracts or glaucoma from the use of corticosteroids.

Inappropriate activation of the complement system has also been shown to be responsible for propagating or initiating pathology in many different neurodegenerative diseases, including, for example, Alzheimer's disease (AD), Amyotrophic Lateral Sclerosis (ALS), schizophrenia, Parkinson's disease (PD), and prion diseases, such as Creutzfeldt-Jakob disease (CJD). For example, neuroinflammation in AD, ALS, schizophrenia, PD, and prion disease is associated with increased microglial and astrocyte activation and C3, as well as other components of the complement system, have been shown to be elevated in regions of increased neuronal death in subjects having such neurodegenerative diseases.

Effective treatments for complement component C3-associated neurodegenerative disease are currently not available and any treatments that are available are palliative. Thus, there remains a need for an agent that can selectively and efficiently silence the C3 gene using the cell's own RNAi machinery that has both high biological activity and in vivo stability, and that can effectively inhibit expression of a target complement component C3 gene.

Thus, there is a need in the art for new and improved compositions and methods for treatment of C3-associated diseases and disorders, such as C3-associated ocular disease and disorders and C3-associated neurodegenerative diseases and disorders.

SUMMARY OF THE INVENTION

The present disclosure provides RNAi agent compositions which effect the RNA-induced silencing complex (RISC)-mediated cleavage of RNA transcripts of a complement component C3 (C3) gene. The C3 gene may be within a cell, e.g., a cell within a subject, such as a human. The present disclosure also provides methods of using the RNAi agent compositions of the disclosure for inhibiting the expression of a C3 gene or for treating a subject who would benefit from inhibiting or reducing the expression of a C3 gene, e.g., a subject suffering or prone to suffering from a complement component C3-associated neurodegenerative disease, e.g., Alzheimer's disease (AD), Amyotrophic Lateral Sclerosis (ALS), schizophrenia, Parkinson's disease (PD), and prion diseases, such as Creutzfeldt-Jakob disease (CJD); or a complement component C3-associated ocular disease, e.g., dry macular degeneration, wet macular degeneration, Basal Laminar drusen, diabetic retinopathy, diabetic macular edema.

Accordingly, in one aspect, the instant disclosure provides a double stranded ribonucleic acid (RNAi) agent for inhibiting expression of a complement component C3 (C3) gene, where the RNAi agent includes a sense strand and an antisense strand, and where the antisense strand includes a region of complementarity which includes at least 15 contiguous nucleotides differing by no more than 3 nucleotides (i.e., differing by 3, 2, 1, or 0 nucleotides) from any one of the antisense sequences listed in any one of Tables 2-9. In certain embodiments, the antisense strand includes a region of complementarity which includes at least 15 contiguous nucleotides of any one of the antisense sequences listed in any one of Tables 2-9. In certain embodiments, the antisense strand includes a region of complementarity which includes at least 19 contiguous nucleotides differing by no more than 3 nucleotides (i.e., differing by 3, 2, 1, or 0 nucleotides) from any one of the antisense sequences listed in any one of Tables 2-9. In certain embodiments, the antisense strand includes a region of complementarity which includes at least 19 contiguous nucleotides of any one of the antisense sequences listed in any one of Tables 2-9. In certain embodiments, thymine-to-uracil or uracil-to-thymine differences between aligned (compared) sequences are not counted as nucleotides that differ between the aligned (compared) sequences.

In some embodiments, the agents include one or more lipophilic moieties conjugated to one or more internal nucleotide positions, optionally via a linker or carrier.

In other embodiments, the agent further comprises a targeting ligand that targets a liver tissue, e.g., one or more GalNAc derivatives, optionally conjugated to the double stranded RNAi agent via a linker or carrier.

In yet other embodiments, the agents further comprise one or more lipophilic moieties conjugated to one or more internal nucleotide positions, optionally via a linker or carrier and a targeting ligand that targets a liver tissue, e.g., one or more GalNAc derivatives, optionally conjugated to the double stranded RNAi agent via a linker or carrier.

In some embodiments, the agents disclosed herein comprise a targeting ligand, e.g., one or more GalNAc derivatives, and do not comprise one or more lipophilic moieties.

Another aspect of the instant disclosure provides a double stranded RNAi agent for inhibiting expression of a complement component C3 (C3) gene, where the dsRNA agent includes a sense strand and an antisense strand, where the sense strand includes at least 15 contiguous nucleotides differing by no more than 3 nucleotides (i.e., differing by 3, 2, 1, or 0 nucleotides) from any one of the sense strand sequences presented in Tables 2-9; and where the antisense strand includes at least 15 contiguous nucleotides differing by no more than 3 nucleotides from any one of antisense strand nucleotide sequences presented in Tables 2-9. In certain embodiments, the sense strand includes at least 15 contiguous nucleotides of any one of the sense strand sequences presented in Tables 2-9; and where the antisense strand includes at least 15 contiguous nucleotides of any one of antisense strand nucleotide sequences presented in Tables 2-9. In certain embodiments, the sense strand includes at least 19 contiguous nucleotides of any one of the sense strand sequences presented in Tables 2-9; and where the antisense strand includes at least 19 contiguous nucleotides of any one of antisense strand nucleotide sequences presented in Tables 2-9 (i.e., differing by 3, 2, 1, or 0 nucleotides) from any one of antisense strand nucleotide sequences presented in Tables 2-9.

In some embodiments, the agents include one or more lipophilic moieties conjugated to one or more internal nucleotide positions, optionally via a linker or carrier.

In other embodiments, the agent further comprises a targeting ligand that targets a liver tissue, e.g., one or more GalNAc derivatives, optionally conjugated to the double stranded RNAi agent via a linker or carrier.

In yet other embodiments, the agents further comprise one or more lipophilic moieties conjugated to one or more internal nucleotide positions, optionally via a linker or carrier and a targeting ligand that targets a liver tissue, e.g., one or more GalNAc derivatives, optionally conjugated to the double stranded RNAi agent via a linker or carrier.

An additional aspect of the disclosure provides a double stranded RNAi agent for inhibiting expression of an complement component C3 (C3) gene, where the dsRNA agent includes a sense strand and an antisense strand, where the sense strand includes at least 15 contiguous nucleotides differing by no more than 3 nucleotides (i.e., differing by 3, 2, 1, or 0 nucleotides) from any one of the nucleotide sequences of SEQ ID NOs: 1-4, or a nucleotide sequence having at least 90% nucleotide sequence identity, e.g. 90, 91, 92, 93, 94, 95, 96, 97, 98, 99, or 100% identity, to the entire nucleotide sequence of any one of SEQ ID NOs: 1-4, where a substitution of a uracil for any thymine of SEQ ID NOs: 1-4 (when comparing aligned sequences) does not count as a difference that contributes to the differing by no more than 3 nucleotides (i.e., differing by 3, 2, 1, or 0 nucleotides) from any one of the nucleotide sequences of SEQ ID NOs: 1-4, or the nucleotide sequence having at least 90% nucleotide sequence identity, e.g. 90, 91, 92, 93, 94, 95, 96, 97, 98, 99, or 100% identity, to the entire nucleotide sequence of any one of SEQ ID NOs: 1-4; and where the antisense strand includes at least 15 contiguous nucleotides differing by no more than 3 nucleotides from any one of the nucleotide sequences of SEQ ID NOs: 5-8, or a nucleotide sequence having at least 90% nucleotide sequence identity, e.g. 90, 91, 92, 93, 94, 95, 96, 97, 98, 99, or 100% identity, to the entire nucleotide sequence of any one of SEQ ID NOs: 5-8, where a substitution of a uracil for any thymine of SEQ ID NOs: 5-8 (when comparing aligned sequences) does not count as a difference that contributes to the differing by no more than 3 nucleotides from any one of the nucleotide sequences of SEQ ID NOs: 5-8, or the nucleotide sequence having at least 90% nucleotide sequence identity, e.g. 90, 91, 92, 93, 94, 95, 96, 97, 98, 99, or 100% identity, to the entire nucleotide sequence of any one of SEQ ID NOs: 5-8, where at least one of the sense strand and the antisense strand includes one or more lipophilic moieties conjugated to one or more internal nucleotide positions, optionally via a linker or carrier.

In one embodiment, the double stranded RNAi agent targeted to C3 comprises a sense strand which includes at least 15 contiguous nucleotides differing by no more than 3 nucleotides (i.e., differing by 3, 2, 1, or 0 nucleotides) from the nucleotide sequence of the sense strand nucleotide sequence of a duplex in Tables 2-9.

In one embodiment, the double stranded RNAi agent targeted to C3 comprises an antisense strand which includes at least 15 contiguous nucleotides differing by no more than 3 nucleotides (i.e., differing by 3, 2, 1, or 0 nucleotides) from the antisense nucleotide sequence of duplex in one of Tables 2-9.

In some embodiments, the agent further comprises a targeting ligand that targets a liver tissue, e.g., one or more GalNAc derivatives, optionally conjugated to the double stranded RNAi agent via a linker or carrier.

Optionally, the double stranded RNAi agent includes at least one modified nucleotide.

In certain embodiments, the lipophilicity of the lipophilic moiety, measured by log $K_{ow}$, exceeds 0.

In some embodiments, the hydrophobicity of the double-stranded RNAi agent, measured by the unbound fraction in a plasma protein binding assay of the double-stranded RNAi agent, exceeds 0.2. In a related embodiment, the plasma protein binding assay is an electrophoretic mobility shift assay using human serum albumin protein.

In certain embodiments, substantially of the nucleotides of the sense strand are modified nucleotides. Optionally, all of the nucleotides of the sense strand are modified nucleotides.

In some embodiments, substantially all of the nucleotides of the antisense strand are modified nucleotides. Optionally, all of the nucleotides of the antisense strand are modified nucleotides.

Optionally, all of the nucleotides of the sense strand and all of the nucleotides of the antisense strand are modified nucleotides.

In one embodiment, at least one of the modified nucleotides is a deoxy-nucleotide, a 3'-terminal deoxythymidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphonate, a nucleotide comprising adenosine-glycol nucleic acid (GNA), a nucleotide comprising thymidine-glycol nucleic acid (GNA) S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, or a terminal nucleotide linked to a cholesteryl derivative or a dodecanoic acid bisdecylamide group.

In a related embodiment, the modified nucleotide is a 2'-deoxy-2'-fluoro modified nucleotide, a 2'-deoxy-modified nucleotide, 3'-terminal deoxythymidine nucleotides (dT), a locked nucleotide, an abasic nucleotide, a 2'-amino-modified nucleotide, a 2'-alkyl-modified nucleotide, a morpholino nucleotide, a phosphoramidate, or a non-natural base comprising nucleotide.

In one embodiment, the modified nucleotide includes a short sequence of 3'-terminal deoxythymidine nucleotides (dT).

In another embodiment, the modifications on the nucleotides are 2'-O-methyl, 2'fluoro, and GNA modifications.

In an additional embodiment, the double stranded RNAi agent includes at least one phosphorothioate internucleotide linkage. Optionally, the double stranded RNAi agent includes 6-8 (e.g., 6, 7, or 8) phosphorothioate internucleotide linkages.

In certain embodiments, the region of complementarity is at least 17 nucleotides in length. Optionally, the region of complementarity is 19-23 nucleotides in length. Optionally, the region of complementarity is 19 nucleotides in length.

In one embodiment, each strand is no more than 30 nucleotides in length.

In another embodiment, at least one strand includes a 3' overhang of at least 1 nucleotide. Optionally, at least one strand includes a 3' overhang of at least 2 nucleotides.

In certain embodiments, the double stranded RNAi agent further includes a lipophilic ligand, e.g., a C16 ligand, conjugated to the 3' end of the sense strand through a monovalent or branched bivalent or trivalent linker.

In one embodiment, the ligand is conjugated at the 2'-position of a nucleotide or modified nucleotide within the sense or antisense strand. For example, a C16 ligand may be conjugated as shown in the following structure:

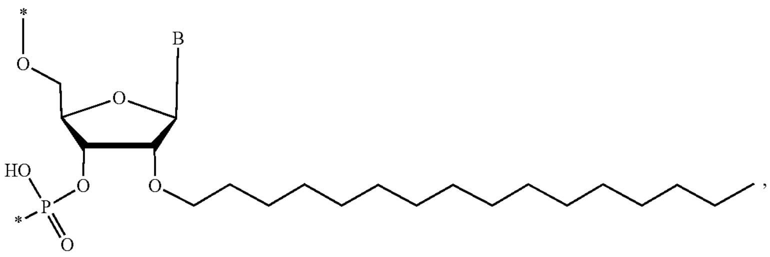

where * denotes a bond to an adjacent nucleotide, and B is a nucleobase or a nucleobase analog, optionally where B is adenine, guanine, cytosine, thymine or uracil.

In other embodiments, the agent further comprises a targeting ligand that targets a liver tissue, e.g., one or more GalNAc derivatives, optionally conjugated to the double stranded RNAi agent via a linker or carrier. In certain embodiments, one of the modified strands in Tables 3, 5, 7, and 9 are conjugated to a targeting ligand that targets a liver tissue. In certain embodiments, the targeting ligand is an L96 ligand, e.g., one or more GalNAc derivatives, optionally conjugated to the double stranded RNAi agent via a linker or carrier. In certain embodiments, the L96 ligand is conjugated to the end of one of the strands. In certain embodiments the L96 ligand is conjugated to the 3' end of the sense strand.

In yet other embodiments, the agents further comprise a lipophilic ligand, e.g., a C16 ligand, conjugated to the 3' end of the sense strand through a monovalent or branched bivalent or trivalent linker and a targeting ligand that targets a liver tissue, e.g., one or more GalNAc derivatives conjugated to the 3' end of the sense strand through a monovalent or branched bivalent or trivalent linker.

In another embodiment, the region of complementarity to C3 includes any one of the antisense sequences in any one of Tables 2-9.

In an additional embodiment, the region of complementarity to C3 is that of any one of the antisense sequences in any one of Tables 2-9. In some embodiments, the internal nucleotide positions include all positions except the terminal two positions from each end of the strand.

In a related embodiment, the internal positions include all positions except terminal three positions from each end of the strand. Optionally, the internal positions exclude the cleavage site region of the sense strand.

In some embodiments, the internal positions exclude positions 9-12, counting from the 5'-end of the sense strand. In certain embodiments, the sense strand is 21 nucleotides in length.

In other embodiments, the internal positions exclude positions 11-13, counting from the 3'-end of the sense strand. Optionally, the internal positions exclude the cleavage site region of the antisense strand. In certain embodiments, the sense strand is 21 nucleotides in length.

In some embodiments, the internal positions exclude positions 12-14, counting from the 5'-end of the antisense strand. In certain embodiments, the antisense strand is 23 nucleotides in length.

In another embodiment, the internal positions excluding positions 11-13 on the sense strand, counting from the 3'-end, and positions 12-14 on the antisense strand, counting from the 5'-end. In certain embodiments, the sense strand is 21 nucleotides in length and the antisense strand is 23 nucleotides in length.

In an additional embodiment, one or more lipophilic moieties are conjugated to one or more of the following internal positions: positions 4-8 and 13-18 on the sense strand, and positions 6-10 and 15-18 on the antisense strand, counting from the 5'end of each strand. Optionally, one or more lipophilic moieties are conjugated to one or more of the following internal positions: positions 5, 6, 7, 15, and 17 on the sense strand, and positions 15 and 17 on the antisense strand, counting from the 5'-end of each strand. In certain embodiments, the sense strand is 21 nucleotides in length and the antisense strand is 23 nucleotides in length.

In certain embodiments, the lipophilic moiety is an aliphatic, alicyclic, or polyalicyclic compound. Optionally, the lipophilic moiety is lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine.

In some embodiments, the lipophilic moiety contains a saturated or unsaturated $C_4$-$C_{30}$ hydrocarbon chain, and an optional functional group selected that is hydroxyl, amine, carboxylic acid, sulfonate, phosphate, thiol, azide, or alkyne.

In certain embodiments, the lipophilic moiety contains a saturated or unsaturated $C_6$-$C_{18}$ hydrocarbon chain. Optionally, the lipophilic moiety contains a saturated or unsaturated $C_{16}$ hydrocarbon chain. In a related embodiment, the lipophilic moiety is conjugated via a carrier that replaces one or more nucleotide(s) in the internal position(s). In certain embodiments, the carrier is a cyclic group that is pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, or decalinyl; or is an acyclic moiety based on a serinol backbone or a diethanolamine backbone.

In some embodiments, the lipophilic moiety is conjugated to the double-stranded RNAi agent via a linker containing an ether, thioether, urea, carbonate, amine, amide, maleimide-thioether, disulfide, phosphodiester, sulfonamide linkage, a product of a click reaction, or carbamate.

In one embodiment, the lipophilic moiety is conjugated to a nucleobase, sugar moiety, or internucleosidic linkage.

In another embodiment, the double-stranded RNAi agent further includes a phosphate or phosphate mimic at the 5'-end of the antisense strand. Optionally, the phosphate mimic is a 5'-vinyl phosphonate (VP).

In certain embodiments, the double-stranded RNAi agent further includes a targeting ligand that targets a receptor which mediates delivery to a CNS tissue, e.g., a hydrophilic ligand. In certain embodiments, the targeting ligand is a C16 ligand.

In some embodiments, the double-stranded RNAi agent further includes a targeting ligand that targets a brain tissue, e.g., striatum.

In some embodiments, the double-stranded RNAi agent further includes a targeting ligand that targets a liver tissue or cell type, e.g., hepatocytes.

In one embodiment, the lipophilic moeity or targeting ligand is conjugated via a bio-cleavable linker that is DNA, RNA, disulfide, amide, functionalized monosaccharides or oligosaccharides of galactosamine, glucosamine, glucose, galactose, mannose, or a combination thereof.

In a related embodiment, the 3' end of the sense strand is protected via an end cap which is a cyclic group having an amine, the cyclic group being pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, or decalinyl.

In one embodiment, the RNAi agent includes at least one modified nucleotide that is a 2'-O-methyl modified nucleotide, a 2'-fluoro modified nucleotide, a nucleotide that includes a glycol nucleic acid (GNA) or a nucleotide that includes a vinyl phosphonate. Optionally, the RNAi agent includes at least one of each of the following modifications: 2'-O-methyl modified nucleotide, a 2'-fluoro modified nucleotide, a nucleotide comprising a glycol nucleic acid (GNA) and a nucleotide comprising vinyl phosphonate.

In another embodiment, the RNAi agent includes a pattern of modified nucleotides as provided below in Tables 2-9 where locations of 2'-C16, 2'-O-methyl, GNA, phosphorothioate, and 2'-fluoro modifications, irrespective of the individual nucleotide base sequences of the displayed RNAi agents.

Another aspect of the instant disclosure provides a double stranded RNAi agent for inhibiting expression of a C3 gene, where the double stranded RNAi agent includes a sense strand complementary to an antisense strand, where the antisense strand includes a region complementary to part of an mRNA encoding C3, where each strand is about 14 to about 30 nucleotides in length, where the double stranded RNAi agent is represented by formula (III):

$$\text{sense: } 5'\ n_p\text{-}N_a\text{—}(X\ X\ X)_i\text{—}N_b\text{—}Y\ Y\ Y\text{—}N_b\text{—}(Z\ Z\ Z)_j\text{—}N_a\text{-}n_q\ 3'$$

$$\text{antisense: } 3'\ n_p'\text{-}N_a'\text{—}(X'X'X')_k\text{—}N_b'\text{—}Y'Y'Y'\text{—}N_b'\text{—}(Z'Z'Z')\text{—}N_a'\text{-}n_q'\ 5' \quad \text{(III)}$$

where:

i, j, k, and l are each independently 0 or 1;

p, p', q, and q' are each independently 0-6;

each $N_a$ and $N_a'$ independently represents an oligonucleotide sequence including 0-25 nucleotides which are either modified or unmodified or combinations thereof, each sequence including at least two differently modified nucleotides;

each $N_b$ and $N_b'$ independently represents an oligonucleotide sequence including 0-10 nucleotides which are either modified or unmodified or combinations thereof;

each $n_p$, $n_p'$, $n_q$, and $n_q'$, each of which may or may not be present, independently represents an overhang nucleotide;

XXX, YYY, ZZZ, X'X'X', Y'Y'Y', and Z'Z'Z' each independently represent one motif of three identical modifications on three consecutive nucleotides;

modifications on $N_b$ differ from the modification on Y and modifications on $N_b'$ differ from the modification on Y'; and where the sense strand is conjugated to at least one ligand.

In one embodiment, i is 0; j is 0; i is 1; j is 1; both i and j are 0; or both i and j are 1.

In another embodiment, k is 0; l is 0; k is 1; l is 1; both k and l are 0; or both k and l are 1.

In certain embodiments, XXX is complementary to X'X'X', YYY is complementary to Y'Y'Y', and ZZZ is complementary to Z'Z'Z'.

In another embodiment, the YYY motif occurs at or near the cleavage site of the sense strand.

In an additional embodiment, the Y'Y'Y' motif occurs at the 11, 12 and 13 positions of the antisense strand from the 5'-end. Optionally, the Y' is 2'-O-methyl.

In some embodiments, formula (III) is represented by formula (IIIa):

sense: 5' $n_p$-$N_a$—Y Y Y—$N_a$-$n_q$ 3' antisense: 3' $n_{p'}$-$N_{a'}$—Y'Y'Y'—$N_{a'}$-$n_{q'}$ 5' (IIIa).

In another embodiment, formula (III) is represented by formula (IIIb):

sense: 5' $n_p$-$N_a$—Y Y Y—$N_b$—Z Z Z—$N_a$-$n_q$ 3' antisense: 3' $n_{p'}$-$N_{a'}$—Y'Y'Y'—$N_{b'}$—Z'Z'Z'—$N_{a'}$-$n_{q'}$ 5' (IIIb)

where each $N_b$ and $N_b'$ independently represents an oligonucleotide sequence including 1-5 modified nucleotides.

In an additional embodiment, formula (III) is represented by formula (IIIc):

sense: 5' $n_p$-$N_a$—X X X—$N_b$—Y Y Y—$N_a$-$n_q$ 3' antisense: 3' $n_{p'}$-$N_{a'}$—X'X'X'—$N_{b'}$—Y'Y'Y'—$N_{a'}$-$n_{q'}$ 5' (IIIc)

where each $N_b$ and $N_b'$ independently represents an oligonucleotide sequence including 1-5 modified nucleotides.

In certain embodiments, formula (III) is represented by formula (IIId):

sense: 5' $n_p$-$N_a$—X X X—$N_b$—Y Y Y—$N_b$—Z Z Z—$N_a$-$n_q$ 3' antisense: 3' $n_{p'}$-$N_{a'}$—X'X'X'—$N_{b'}$—Y'Y'Y'—$N_{b'}$—Z'Z'Z'—$N_{a'}$-$n_{q'}$ 5' (IIId)

where each $N_b$ and $N_b'$ independently represents an oligonucleotide sequence including 1-5 modified nucleotides and each $N_a$ and $N_a'$ independently represents an oligonucleotide sequence including 2-10 modified nucleotides.

In another embodiment, the double stranded region is 15-30 nucleotide pairs in length. Optionally, the double stranded region is 17-23 nucleotide pairs in length.

In certain embodiments, the double stranded region is 17-25 nucleotide pairs in length. Optionally, the double stranded region is 23-27 nucleotide pairs in length.

In some embodiments, the double stranded region is 19-21 nucleotide pairs in length. Optionally, the double stranded region is 21-23 nucleotide pairs in length.

In certain embodiments, each strand independently has 15-30 nucleotides. Optionally, each strand independently has 19-30 nucleotides. Optionally, each strand independently has 19-23 nucleotides.

In certain embodiments, the double stranded region is 19-21 nucleotide pairs in length and each strand has 19-23 nucleotides.

In another embodiment, the modifications on the nucleotides of the RNAi agent are LNA, glycol nucleic acid (GNA), HNA, CeNA, 2'-methoxyethyl, 2'-O-alkyl, 2'-O-allyl, 2'-C-allyl, 2'-fluoro, 2'-deoxy or 2'-hydroxyl, and combinations thereof. Optionally, the modifications on nucleotides include 2'-O-methyl, 2'-fluoro, or GNA, and combinations thereof. In a related embodiment, the modifications on the nucleotides are 2'-O-methyl or 2'-fluoro modifications.

In one embodiment the RNAi agent includes a ligand that is or includes one or more lipophilic, e.g., C16, moieties attached through a bivalent or trivalent branched linker.

In other embodiments, the agent further comprises a targeting ligand that targets a liver tissue, e.g., one or more GalNAc derivatives.

In yet other embodiments, the agents further comprise a lipophilic ligand, e.g., a C16 ligand, conjugated to the 3' end of the sense strand through a monovalent or branched bivalent or trivalent linker and a targeting ligand that targets a liver tissue, e.g., one or more GalNAc derivatives conjugated to the 3' end of the sense strand through a monovalent or branched bivalent or trivalent linker.

In certain embodiments, the ligand is attached to the 3' end of the sense strand.

In some embodiments, the RNAi agent further includes at least one phosphorothioate or methylphosphonate internucleotide linkage. In a related embodiment, the phosphorothioate or methylphosphonate internucleotide linkage is at the 3'-terminus of one strand. Optionally, the strand is the antisense strand. In another embodiment, the strand is the sense strand. In a related embodiment, the phosphorothioate or methylphosphonate internucleotide linkage is at the 5'-terminus of one strand. Optionally, the strand is the antisense strand. In another embodiment, the strand is the sense strand.

In another embodiment, the phosphorothioate or methylphosphonate internucleotide linkage is at the both the 5'- and 3'-terminus of one strand. Optionally, the strand is the antisense strand. In another embodiment, the strand is the sense strand.

In an additional embodiment, the base pair at the 1 position of the 5'-end of the antisense strand of the RNAi agent duplex is an A:U base pair.

In certain embodiments, the Y nucleotides contain a 2'-fluoro modification.

In some embodiments, the Y' nucleotides contain a 2'-O-methyl modification.

In certain embodiments, p'>0. Optionally, p'=2.

In some embodiments, q'=0, p=0, q=0, and p' overhang nucleotides are complementary to the target mRNA.

In certain embodiments, q'=0, p=0, q=0, and p' overhang nucleotides are non-complementary to the target mRNA.

In one embodiment, the sense strand of the RNAi agent has a total of 21 nucleotides and the antisense strand has a total of 23 nucleotides.

In another embodiment, at least one $n_p$' is linked to a neighboring nucleotide via a phosphorothioate linkage. Optionally, all $n_p$' are linked to neighboring nucleotides via phosphorothioate linkages.

In certain embodiments, the C3 RNAi agent of the instant disclosure is one of those listed in Tables 2-9. In some embodiments, all of the nucleotides of the sense strand and all of the nucleotides of the antisense strand include a modification.

Another aspect of the instant disclosure provides a double stranded RNAi agent for inhibiting expression of a C3 gene in a cell, where the double stranded RNAi agent includes a sense strand complementary to an antisense strand, where the antisense strand includes a region complementary to part of an mRNA encoding a C3 gene, where each strand is about 14 to about 30 nucleotides in length, where the double stranded RNAi agent is represented by formula (III):

$$\text{sense: } 5'\ n_p\text{-}N_a\text{—}(X\ X\ X)_i\text{—}N_b\text{—}Y\ Y\ Y\text{—}N_b\text{—}(Z\ Z\ Z)_j\text{—}N_a\text{-}n_q\ 3'$$

$$\text{antisense: } 3'\ n_p'\text{-}N_a'\text{—}(X'X'X')_k\text{—}N_b'\text{—}Y'Y'Y'\text{—}N_b'\text{—}(Z'Z'Z')\text{—}N_a'\text{-}n_q'\ 5' \quad \text{(III)}$$

where:

i, j, k, and l are each independently 0 or 1;

p, p', q, and q' are each independently 0-6;

each $N_a$ and $N_a$' independently represents an oligonucleotide sequence including 0-25 nucleotides which are either modified or unmodified or combinations thereof, each sequence including at least two differently modified nucleotides;

each $N_b$ and $N_b$' independently represents an oligonucleotide sequence including 0-10 nucleotides which are either modified or unmodified or combinations thereof;

each $n_p$, $n_p$', $n_q$, and $n_q$', each of which may or may not be present independently represents an overhang nucleotide;

XXX, YYY, ZZZ, X'X'X', Y'Y'Y', and Z'Z'Z' each independently represent one motif of three identical modifications on three consecutive nucleotides, and where the modifications are 2'-O-methyl or 2'-fluoro modifications;

modifications on $N_b$ differ from the modification on Y and modifications on $N_b$' differ from the modification on Y'; and where the sense strand is conjugated to at least one ligand, optionally where the ligand is one or more lipophilic, e.g., C16, ligands, or one or more GalNAc derivatives.

An additional aspect of the instant disclosure provides a double stranded RNAi agent for inhibiting expression of a C3 gene in a cell, where the double stranded RNAi agent includes a sense strand complementary to an antisense strand, where the antisense strand includes a region complementary to part of an mRNA encoding C3, where each strand is about 14 to about 30 nucleotides in length, where the double stranded RNAi agent is represented by formula (III):

$$\text{sense: } 5'\ n_p\text{-}N_a\text{—}(X\ X\ X)_i\text{—}N_b\text{—}Y\ Y\ Y\text{—}N_b\text{—}(Z\ Z\ Z)_j\text{—}N_a\text{-}n_q\ 3'$$

$$\text{antisense: } 3'\ n_p'\text{-}N_a'\text{—}(X'X'X')_k\text{—}N_b'\text{—}Y'Y'Y'\text{—}N_b'\text{—}(Z'Z'Z')\text{—}N_a'\text{-}n_q'\ 5' \quad \text{(III)}$$

where:

i, j, k, and l are each independently 0 or 1;

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence including 0-25 nucleotides which are either modified or unmodified or combinations thereof, each sequence including at least two differently modified nucleotides;

each $N_b$ and $N_b$' independently represents an oligonucleotide sequence including 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and where the modifications are 2'-O-methyl, glycol nucleic acid (GNA) or 2'-fluoro modifications;

modifications on $N_b$ differ from the modification on Y and modifications on $N_b$' differ from the modification on Y'; and where the sense strand is conjugated to at least one ligand, optionally where the ligand is one or more lipophilic, e.g., C16, ligands, or one or more GalNAc derivatives.

Another aspect of the instant disclosure provides a double stranded RNAi agent for inhibiting expression of a C3 gene in a cell, where the double stranded RNAi agent includes a sense strand complementary to an antisense strand, where the antisense strand includes a region complementary to part of an mRNA encoding C3 (SEQ ID NO: 1, or a nucleotide sequence having at least 90% nucleotide sequence identity, e.g. 90, 91, 92, 93, 94, 95, 96, 97, 98, 99 or 100% identity, to the entire nucleotide sequence of SEQ ID NO:1), where each strand is about 14 to about 30 nucleotides in length, where the double stranded RNAi agent is represented by formula (III):

$$\text{sense: } 5'\ n_p\text{-}N_a\text{—}(X\ X\ X)_i\text{—}N_b\text{—}Y\ Y\ Y\text{—}N_b\text{—}(Z\ Z\ Z)_j\text{—}N_a\text{-}n_q\ 3'$$

$$\text{antisense: } 3'\ n_p'\text{-}N_a'\text{—}(X'X'X')_k\text{—}N_b'\text{—}Y'Y'Y'\text{—}N_b'\text{—}(Z'Z'Z')\text{—}N_a'\text{-}n_q'\ 5' \quad \text{(III)}$$

where:

i, j, k, and l are each independently 0 or 1;

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence including 0-25 nucleotides which are either modified or unmodified or combinations thereof, each sequence including at least two differently modified nucleotides;

each $N_b$ and $N_b$' independently represents an oligonucleotide sequence including 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and where the modifications are 2'-O-methyl or 2'-fluoro modifications;

modifications on $N_b$ differ from the modification on Y and modifications on $N_b$' differ from the modification on Y'; and where the sense strand is conjugated to at least one ligand, optionally where the ligand is one or more lipophilic, e.g., C16, ligands, or one or more GalNAc derivatives.

An additional aspect of the instant disclosure provides a double stranded RNAi agent for inhibiting expression of a C3 gene in a cell, where the double stranded RNAi agent includes a sense strand complementary to an antisense strand, where the antisense strand includes a region complementary to part of an mRNA encoding C3 (SEQ ID NO: 1, or a nucleotide sequence having at least 90% nucleotide sequence identity, e.g. 90, 91, 92, 93, 94, 95, 96, 97, 98, 99, or 100% identity, to the entire nucleotide sequence of SEQ ID NO: 1), where each strand is about 14 to about 30 nucleotides in length, where the double stranded RNAi agent is represented by formula (III):

$$\text{sense: } 5'\ n_p\text{-}N_a\text{—}(X\ X\ X)_i\text{—}N_b\text{—}Y\ Y\ Y\text{—}N_b\text{—}(Z\ Z\ Z)_j\text{—}N_a\text{-}n_q\ 3'$$

$$\text{antisense: } 3'\ n_p'\text{-}N_a'\text{—}(X'X'X')_k\text{—}N_b'\text{—}Y'Y'Y'\text{—}N_b'\text{—}(Z'Z'Z')_l\text{—}N_a'\text{-}n_q'\ 5' \qquad \text{(III)}$$

where:

i, j, k, and l are each independently 0 or 1;

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence including 0-25 nucleotides which are either modified or unmodified or combinations thereof, each sequence including at least two differently modified nucleotides;

each $N_b$ and $N_b$' independently represents an oligonucleotide sequence including 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and where the modifications are 2'-O-methyl or 2'-fluoro modifications;

modifications on $N_b$ differ from the modification on Y and modifications on $N_b$' differ from the modification on Y';

where the sense strand includes at least one phosphorothioate linkage; and where the sense strand is conjugated to at least one ligand, optionally where the ligand is one or more lipophilic, e.g., C16, ligands or one or more GalNAc derivatives.

Another aspect of the instant disclosure provides a double stranded RNAi agent for inhibiting expression of a C3 gene in a cell, where the double stranded RNAi agent includes a sense strand complementary to an antisense strand, where the antisense strand includes a region complementary to part of an mRNA encoding C3 (SEQ ID NO: 1), or a nucleotide sequence having at least 90% nucleotide sequence identity, e.g. 90, 91, 92, 93, 94, 95, 96, 97, 98, 99, or 100% identity, to the entire nucleotide sequence of SEQ ID NO: 1), where each strand is about 14 to about 30 nucleotides in length, where the double stranded RNAi agent is represented by formula (III):

$$\text{sense: } 5'\ n_p\text{-}N_a\text{—}Y\ Y\ Y\text{—}N_a\text{-}n_q\ 3'$$

$$\text{antisense: } 3'\ n_{p'}\text{-}N_{a'}\text{—}Y'Y'Y'\text{—}N_{a'}\text{-}n_{q'}\ 5' \qquad \text{(IIIa)}$$

where:

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence including 0-25 nucleotides which are either modified or unmodified or combinations thereof, each sequence including at least two differently modified nucleotides;

YYY and Y'Y'Y' each independently represent one motif of three identical modifications on three consecutive nucleotides, and where the modifications are 2'-O-methyl or 2'-fluoro modifications;

where the sense strand includes at least one phosphorothioate linkage; and where the sense strand is conjugated to at least one ligand, optionally where the ligand is one or more lipophilic, e.g., C16 ligands, or one or more GalNAc derivatives.

An additional aspect of the instant disclosure provides a double stranded RNAi agent for inhibiting expression of a C3 gene, where the double stranded RNAi agent targeted to C3 includes a sense strand and an antisense strand forming a double stranded region, where the sense strand includes at least 15 contiguous nucleotides differing by no more than 3 nucleotides (i.e., differing by 3, 2, 1, or 0 nucleotides) from any one of the nucleotide sequences of SEQ ID NOs: 1-4, or a nucleotide sequence having at least 90% nucleotide sequence identity, e.g. 90, 91, 92, 93, 94, 95, 96, 97, 98, 99, or 100% identity, to the entire nucleotide sequence of any one of SEQ ID NOs: 1-4, and the antisense strand includes at least 15 contiguous nucleotides differing by no more than 3 nucleotides (i.e., differing by 3, 2, 1, or 0 nucleotides) from any one of the nucleotide sequences of SEQ ID NOs: 5-8, or a nucleotide sequence having at least 90% nucleotide sequence identity, e.g. 90, 91, 92, 93, 94, 95, 96, 97, 98, 99, or 100% identity, to the entire nucleotide sequence of any one of SEQ ID NOs: 5-8; where a substitution of a uracil for any thymine in the sequences provided in the SEQ ID NOs: 1-8 (when comparing aligned sequences) does not count as a difference that contributes to the differing by no more than 3 nucleotides from any one of the nucleotide sequences provided in SEQ ID NOs: 1-8, where substantially all of the nucleotides of the sense strand include a modification that is a 2'-O-methyl modification, a GNA, or a 2'-fluoro modification, where the sense strand includes two phosphorothioate internucleotide linkages at the 5'-terminus, where substantially all of the nucleotides of the antisense strand include a modification selected from the group consisting of a 2'-O-methyl modification and a 2'-fluoro modification, where the antisense strand includes two phosphorothioate internucleotide linkages at the 5'-terminus and two phosphorothioate internucleotide linkages at the 3'-terminus, and where the sense strand is conjugated to one or more lipophilic, e.g., C16, ligands, optionally, further comprising a liver targeting ligand, e.g., a ligand comprising one or more GalNAc derivatives.

Another aspect of the instant disclosure provides a double stranded RNAi agent for inhibiting expression of a C3 gene, where the double stranded RNAi agent targeted to C3 includes a sense strand and an antisense strand forming a double stranded region, where the sense strand includes at least 15 contiguous nucleotides differing by no more than 3 nucleotides (i.e., differing by 3, 2, 1, or 0 nucleotides) from any one of the nucleotide sequences of SEQ ID NOs: 1-4, or a nucleotide sequence having at least 90% nucleotide sequence identity, e.g. 90, 91, 92, 93, 94, 95, 96, 97, 98, 99, or 100% identity, to the entire nucleotide sequence of any one of SEQ ID NOs: 1-4, and the antisense strand includes at least 15 contiguous nucleotides differing by no more than 3 nucleotides (i.e., differing by 3, 2, 1, or 0 nucleotides) from any one of the nucleotide sequences of SEQ ID NOs: 5-8, or a nucleotide sequence having at least 90% nucleotide sequence identity, e.g. 90, 91, 92, 93, 94, 95, 96, 97, 98, 99, or 100% identity, to the entire nucleotide sequence of any one of SEQ ID NOs: 5-88, where a substitution of a uracil for any thymine in the sequences provided in the SEQ ID NOs: 1-8 (when comparing aligned sequences) does not count as a difference that contributes to the differing by no more than 3 nucleotides from any one of the nucleotide sequences provided in SEQ ID NOs:1-8; where the sense strand includes at least one 3'-terminal deoxythymidine nucleotide (dT), and where the antisense strand includes at least one 3'-terminal deoxythymidine nucleotide (dT).

In one embodiment, all of the nucleotides of the sense strand and all of the nucleotides of the antisense strand are modified nucleotides.

In another embodiment, each strand has 19-30 nucleotides.

In certain embodiments, the antisense strand of the RNAi agent includes at least one thermally destabilizing modification of the duplex within the first 9 nucleotide positions of the 5' region or a precursor thereof. Optionally, the thermally destabilizing modification of the duplex is one or more of

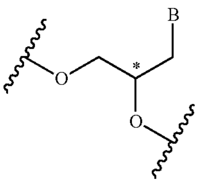

,

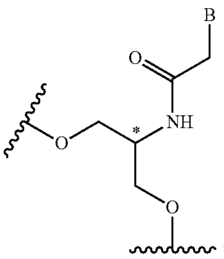

,

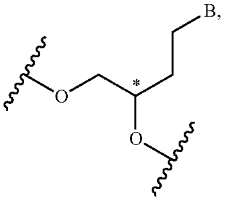

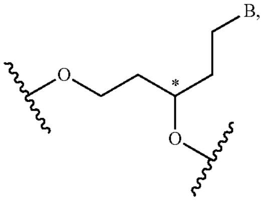

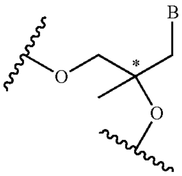

, and

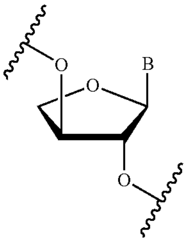

where B is nucleobase.

An additional aspect of the instant disclosure provides a double stranded ribonucleic acid (RNAi) agent for inhibiting expression of a C3 gene, where the RNAi agent possesses a sense strand and an antisense strand, and where the antisense strand includes a region of complementarity which includes at least 15 contiguous nucleotides differing by no more than 3 nucleotides (i.e., differing by 3, 2, 1, or 0 nucleotides), e.g., at least 15 nucleotides (i.e., differing by 3, 2, 1, or 0 nucleotides), at least 19 nucleotides (i.e., differing by 3, 2, 1, or 0 nucleotides), from any one of the antisense strand nucleobase sequences of Tables 2-9. In one embodiment, the RNAi agent includes one or more of the following modifications: a 2'-O-methyl modified nucleotide, a 2'-fluoro modified nucleotide, a 2'-C-alkyl-modified nucleotide, a nucleotide comprising a glycol nucleic acid (GNA), a phosphorothioate (PS) and a vinyl phosphonate (VP). Optionally, the RNAi agent includes at least one of each of the following modifications: a 2'-O-methyl modified nucleotide, a 2'-fluoro modified nucleotide, a 2'-C-alkyl-modified nucleotide, a nucleotide comprising a glycol nucleic acid (GNA), a phosphorothioate and a vinyl phosphonate (VP).

In another embodiment, the RNAi agent includes four or more PS modifications, optionally six to ten PS modifications, optionally eight PS modifications.

In an additional embodiment, each of the sense strand and the antisense strand of the RNAi agent possesses a 5'-terminus and a 3'-terminus, and the RNAi agent includes eight PS modifications positioned at each of the penultimate and ultimate internucleotide linkages from the respective 3'- and 5'-termini of each of the sense and antisense strands of the RNAi agent.

In another embodiment, each of the sense strand and the antisense strand of the RNAi agent includes a 5'-terminus and a 3'-terminus, and the RNAi agent includes only one nucleotide including a GNA. Optionally, the nucleotide including a GNA is positioned on the antisense strand at the seventh nucleobase residue from the 5'-terminus of the antisense strand.

In an additional embodiment, each of the sense strand and the antisense strand of the RNAi agent includes a 5'-terminus and a 3'-terminus, and the RNAi agent includes one to four 2'-C-alkyl-modified nucleotides. Optionally, the 2'-C-alkyl-modified nucleotide is a 2'-C16-modified nucleotide. Optionally, the RNAi agent includes a single 2'-C-alkyl, e.g., C16-modified nucleotide. Optionally, the single 2'-C-alkyl, e.g., C16-modified nucleotide is located on the sense strand at the sixth nucleobase position from the 5'-terminus of the sense strand.

In another embodiment, each of the sense strand and the antisense strand of the RNAi agent includes a 5'-terminus and a 3'-terminus, and the RNAi agent includes two or more 2'-fluoro modified nucleotides. Optionally, each of the sense strand and the antisense strand of the RNAi agent includes two or more 2'-fluoro modified nucleotides. Optionally, the 2'-fluoro modified nucleotides are located on the sense strand at nucleobase positions 7, 9, 10, and 11 from the 5'-terminus of the sense strand and on the antisense strand at nucleobase positions 2, 14, and 16 from the 5'-terminus of the antisense strand.

In an additional embodiment, each of the sense strand and the antisense strand of the RNAi agent includes a 5'-terminus and a 3'-terminus, and the RNAi agent includes one or more VP modifications. Optionally, the RNAi agent includes a single VP modification at the 5'-terminus of the antisense strand.

In another embodiment, each of the sense strand and the antisense strand of the RNAi agent includes a 5'-terminus and a 3'-terminus, and the RNAi agent includes two or more 2'-O-methyl modified nucleotides. Optionally, the RNAi agent includes 2'-O-methyl modified nucleotides at all nucleobase locations not modified by a 2'-fluoro, a 2'-C-alkyl or a glycol nucleic acid (GNA). Optionally, the two or more 2'-O-methyl modified nucleotides are located on the sense strand at positions 1, 2, 3, 4, 5, 8, 12, 13, 14, 15, 16, 17, 18, 19, 20, and 21 from the 5'-terminus of the sense strand and on the antisense strand at positions 1, 3, 4, 5, 6, 8, 9, 10, 11, 12, 13, 15, 17, 18, 19, 20, 21, 22 and 23 from the 5'-terminus of the antisense strand.

In one aspect, the present invention provides double stranded RNAi agent for inhibiting expression of a complement component C3 gene in a cell, comprising a sense strand and an antisense strand forming a double stranded region, wherein the sense strand comprises a nucleotide sequence comprising at least 15 contiguous nucleotides, with 0 or 1 mismatches, of a portion of the nucleotide sequence of SEQ ID NO:1, or a nucleotide sequence having at least 90% nucleotide sequence identity to a portion of the nucleotide sequence of SEQ ID NO:1, and the antisense strand comprises a nucleotide sequence comprising at least 15 contiguous nucleotides, with 0 or 1 mismatches, of the corresponding portion of the nucleotide sequence of SEQ ID NO:5, or a nucleotide sequence having at least 90% nucleotide sequence identity to the portion of the nucleotide sequence of SEQ ID NO:5, and wherein the double stranded RNAi agent comprises one or more lipophilic monomer, wherein the lipophilic monomer is selected from the group consisting of:

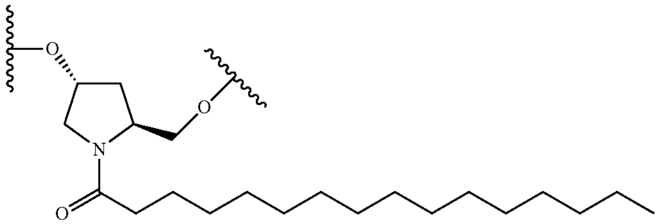
;

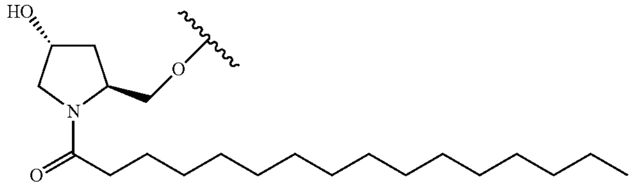
;

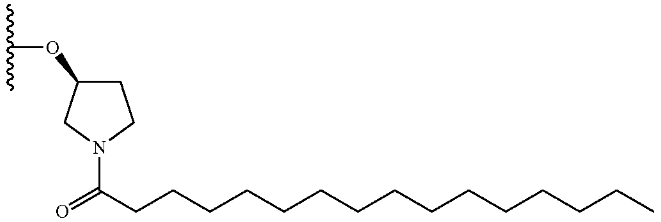
;

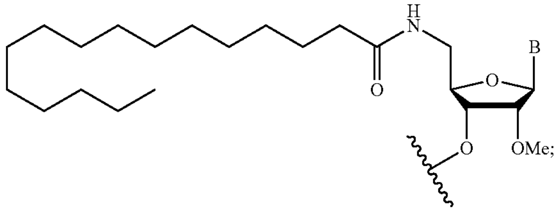

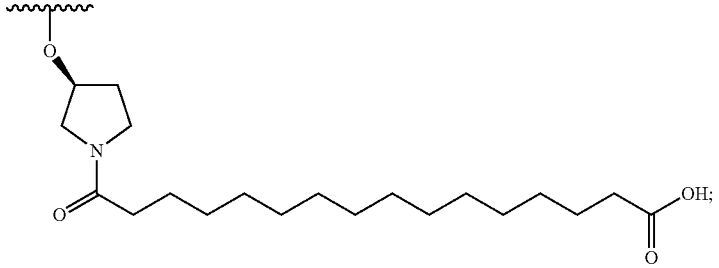

-continued
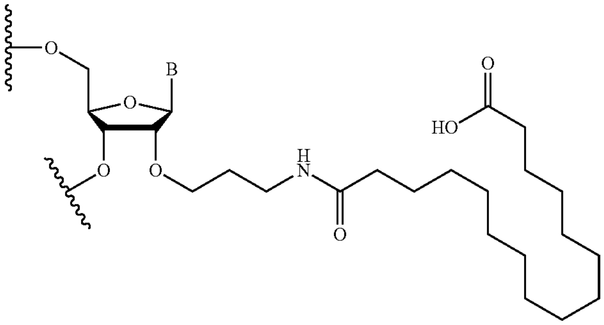
;
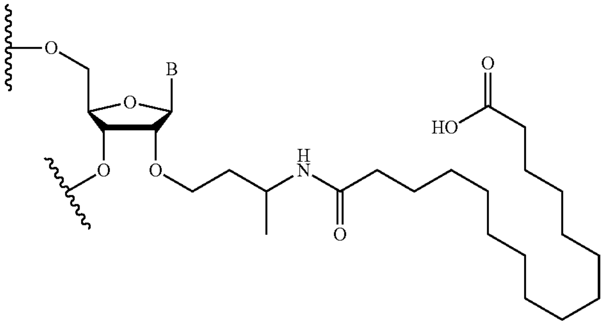
;
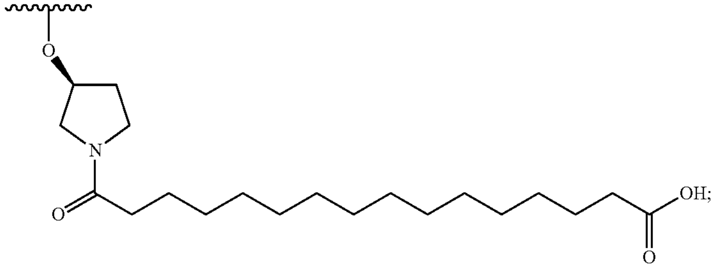
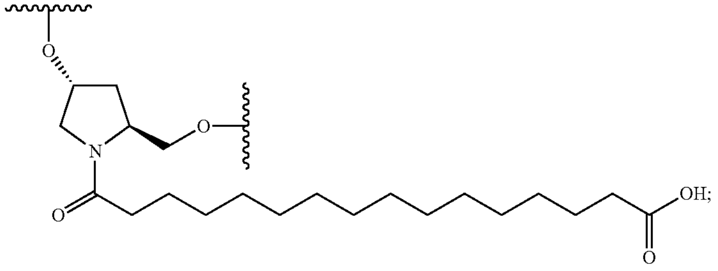
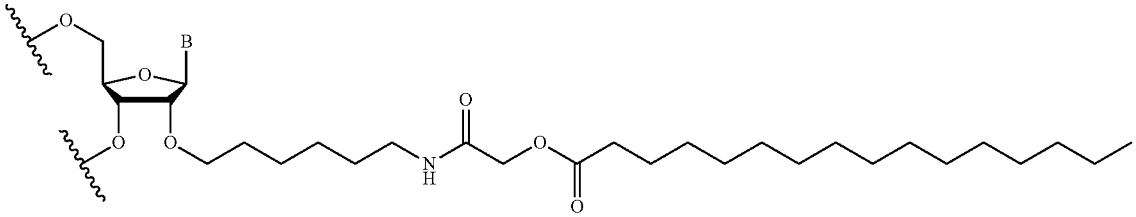
;
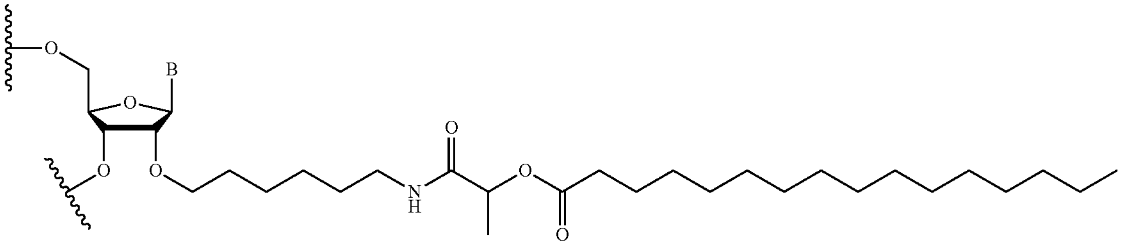
;

-continued
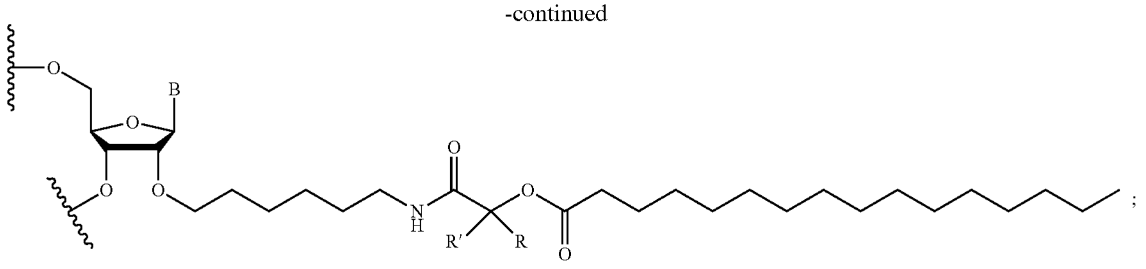
R, R′ = H or $CH_3$, Ethyl, isopropyl, tButyl
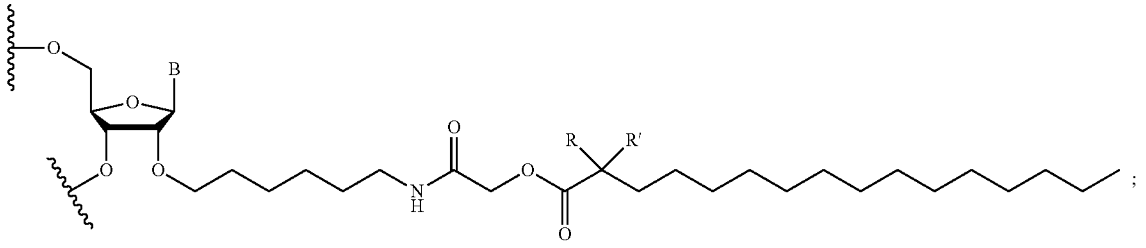
R, R′ = H or $CH_3$, Ethyl, isopropyl, tButyl
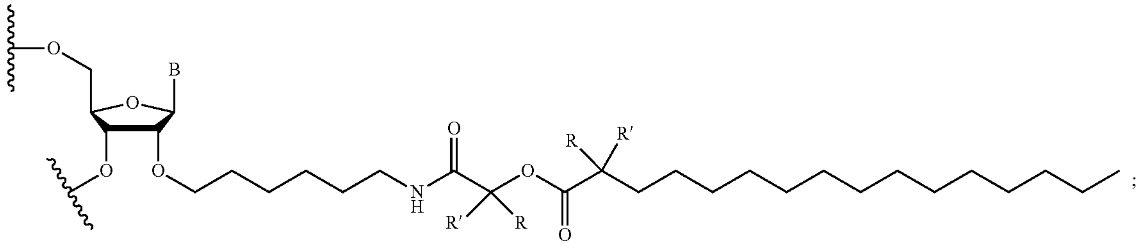
R, R′ = H or $CH_3$, Ethyl, isopropyl, tButyl
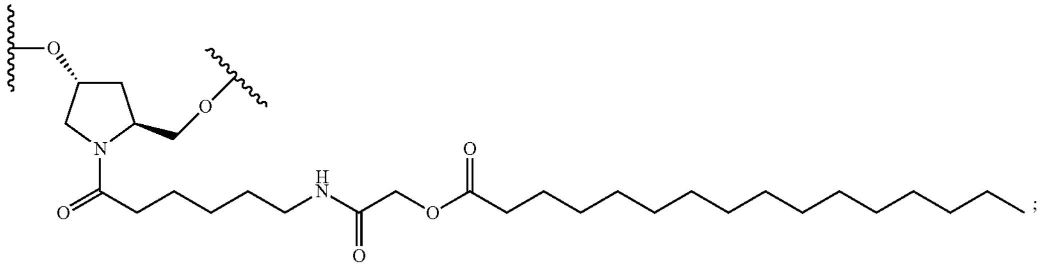
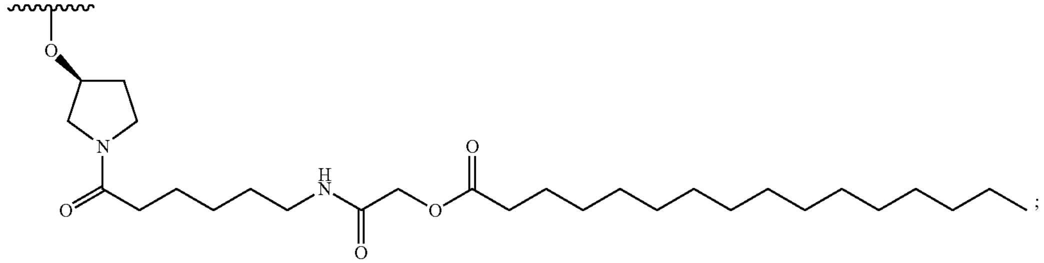
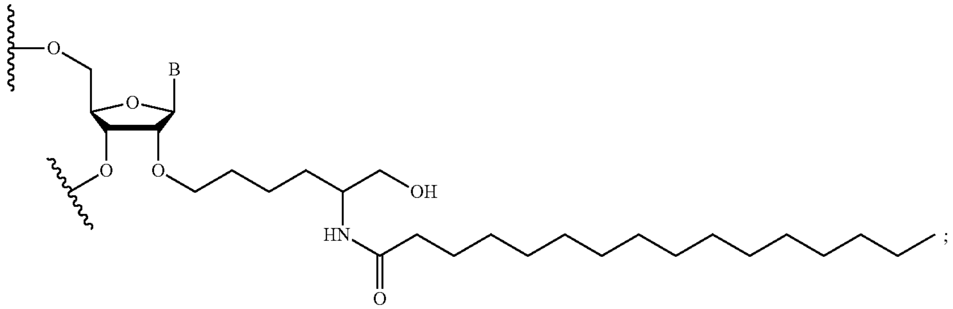

-continued

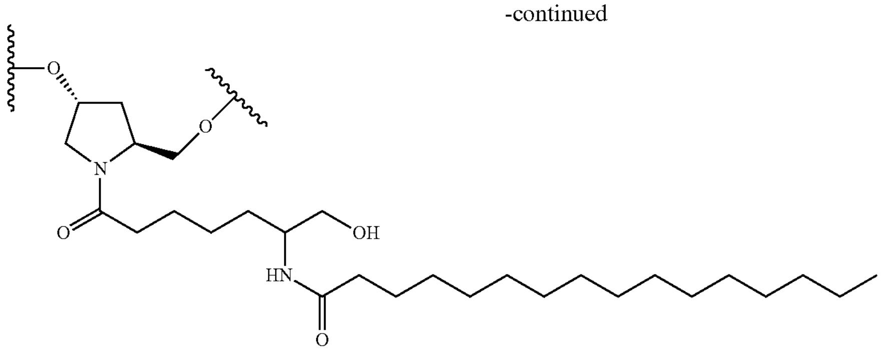

;

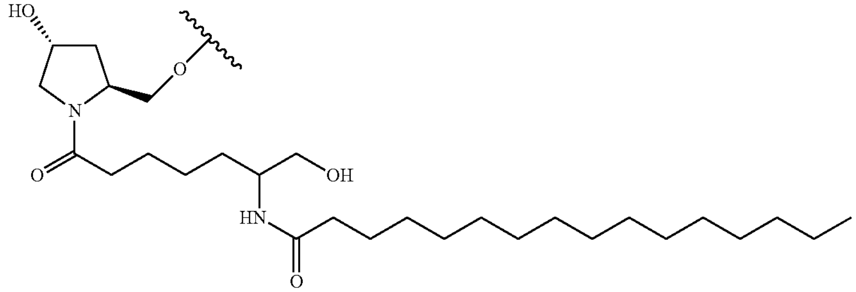

;

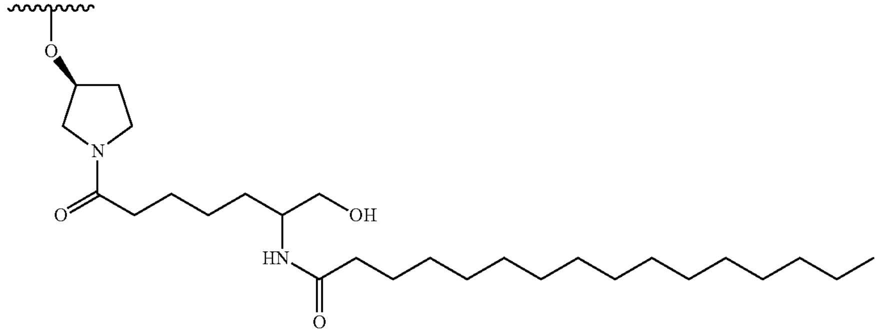

; and

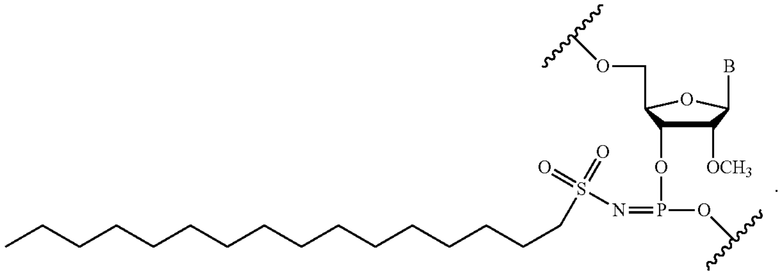

.

In another aspect, the present invention provides a double stranded RNAi agent for inhibiting expression of a complement component C3 gene in a cell, comprising a sense strand and an antisense strand forming a double stranded region, wherein said antisense strand comprises a region complementary to part of an mRNA encoding complement component C3 (SEQ ID NO:1), wherein each strand independently is 14 to 30 nucleotides in length; and wherein the double stranded RNAi agent comprises one or more lipophilic monomer, wherein the lipophilic monomer is selected from the group consisting of:

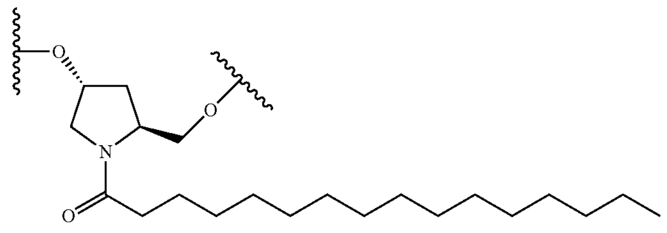

;

-continued
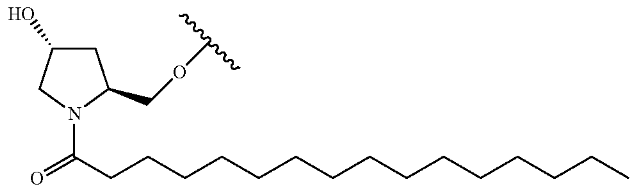
;
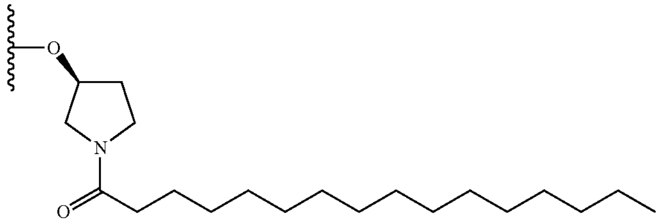
;
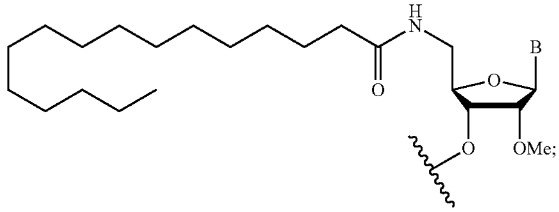
;
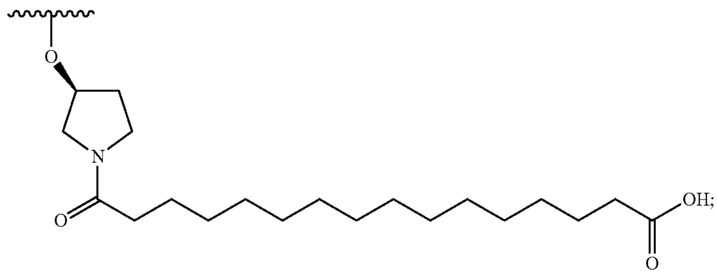
;
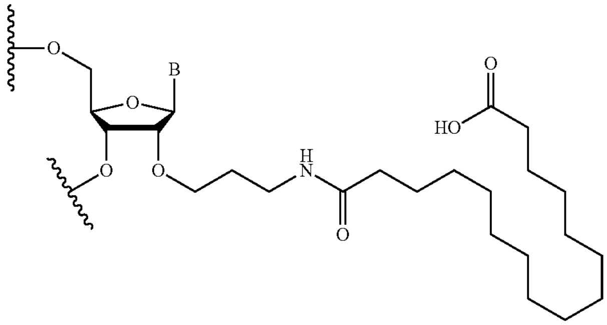
;
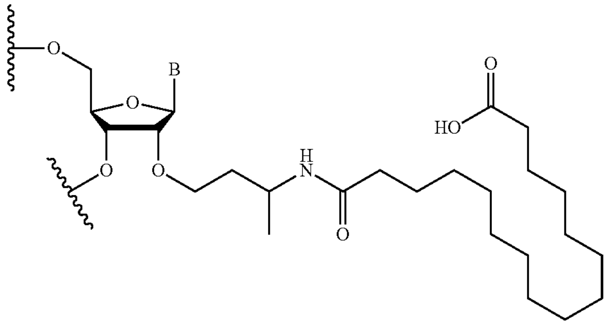
;

-continued
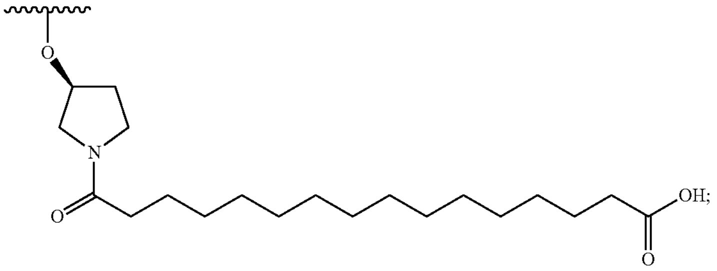
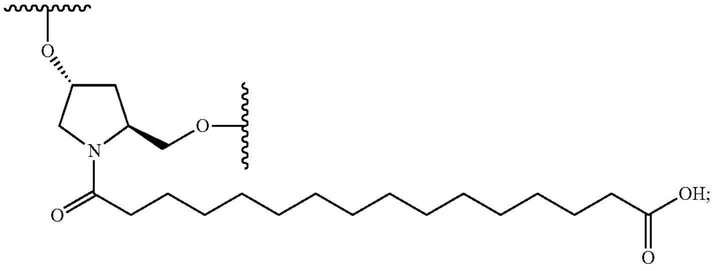
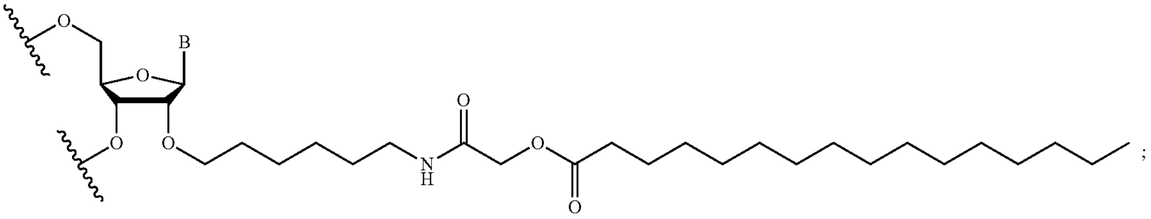
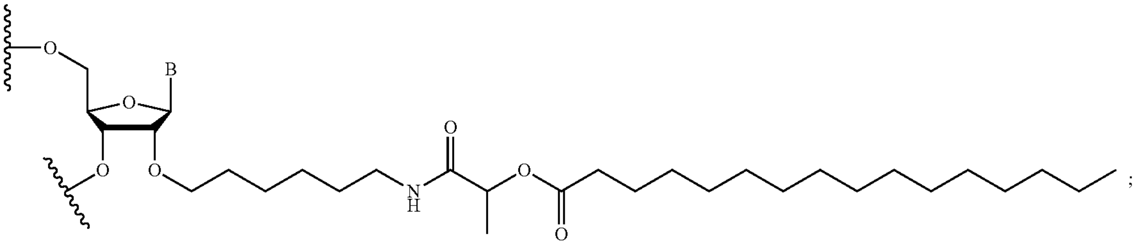
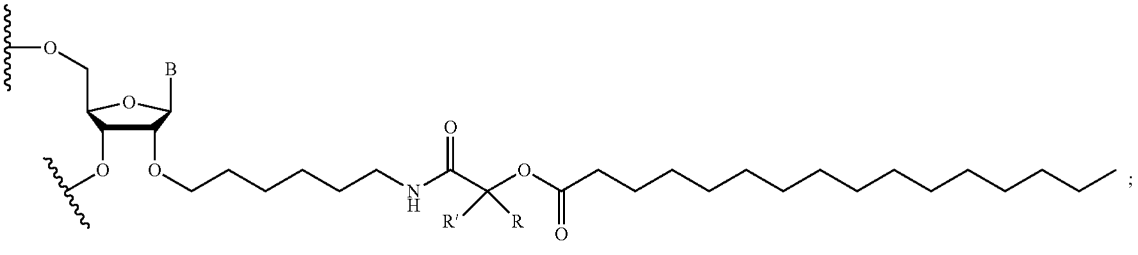
R, R′ = H or $CH_3$, Ethyl, isopropyl, tButyl
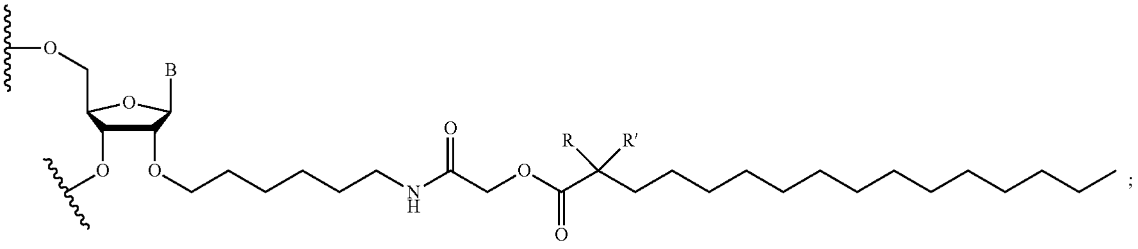
R, R′ = H or $CH_3$, Ethyl, isopropyl, tButyl -continued
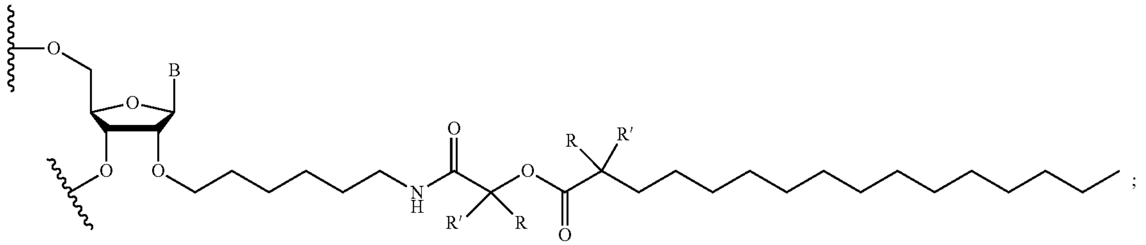
R, R′ = H or $CH_3$, Ethyl, isopropyl, tButyl
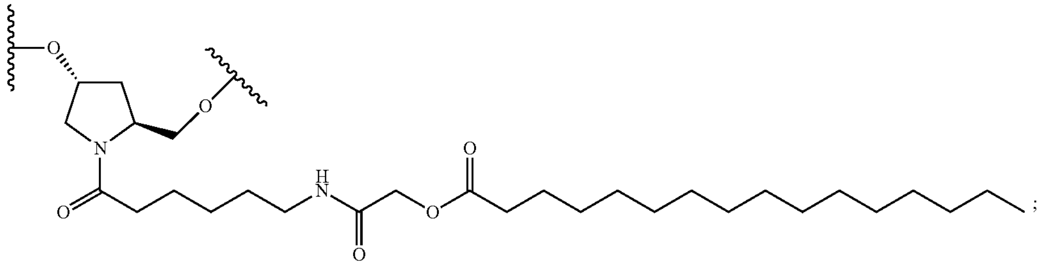
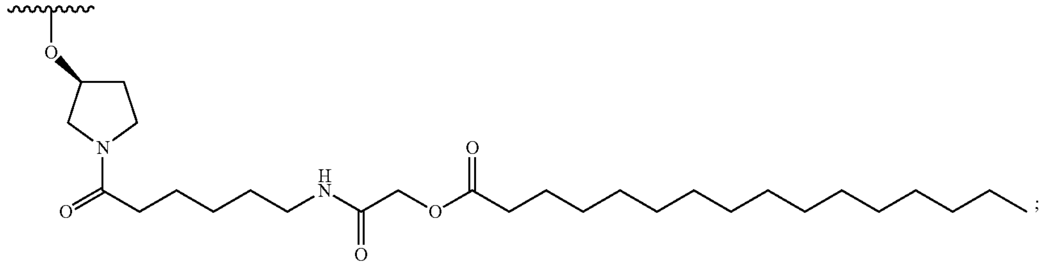
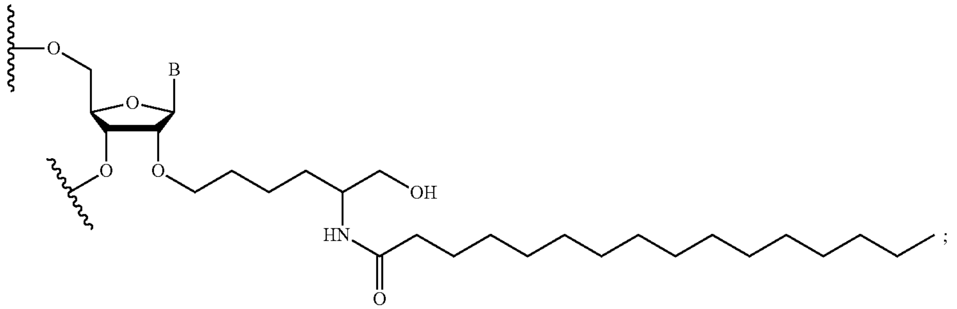
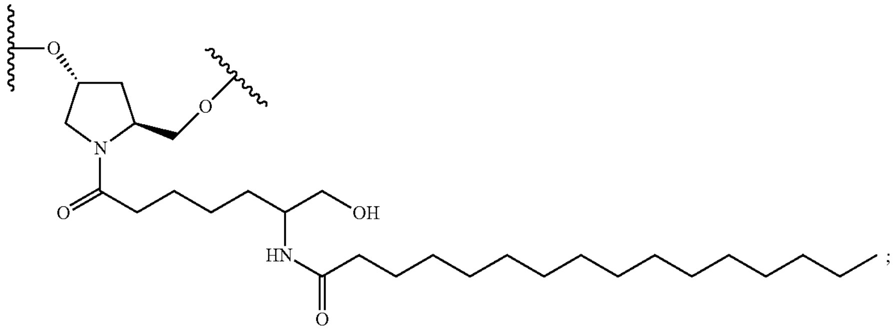

-continued

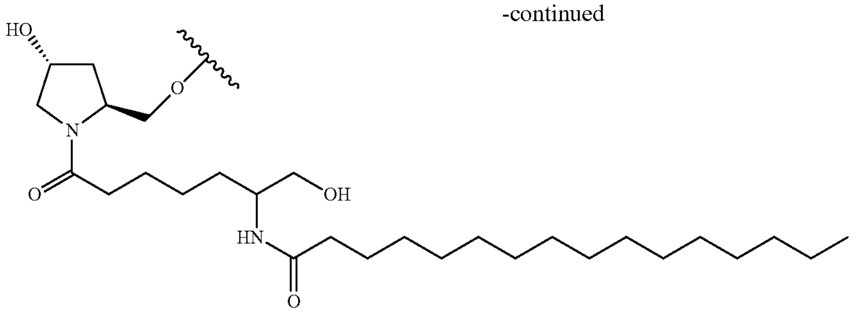

;

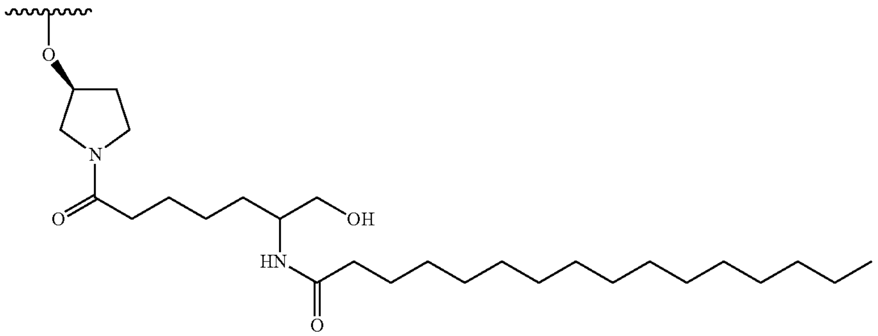

; and

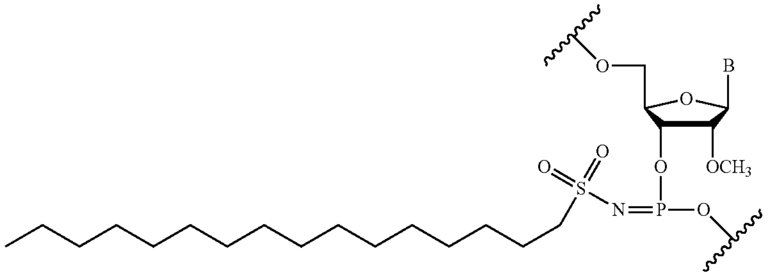

.

In yet another aspect, the present invention provides a double stranded RNAi agent for inhibiting expression of a complement component C3 gene in a cell, comprising a sense strand and an antisense strand forming a double stranded region, wherein the antisense strand comprises at least 15 contiguous nucleotides differing by no more than 3 nucleotides from any one of the antisense nucleotide sequences in any one of Tables 2-9, wherein each strand independently is 14 to 30 nucleotides in length; and wherein the double stranded RNAi agent comprises one or more lipophilic monomer, wherein the lipophilic monomer is selected from the group consisting of:

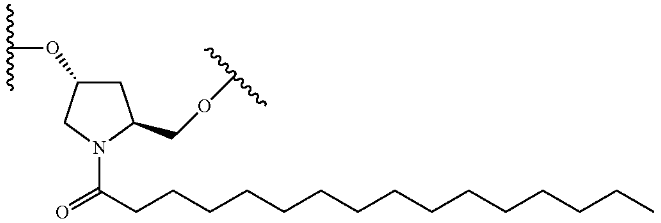

;

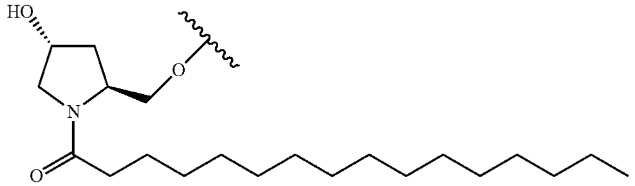

;

-continued
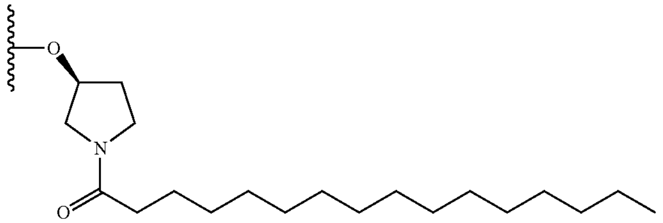
;
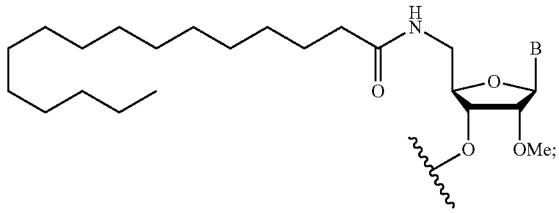
;
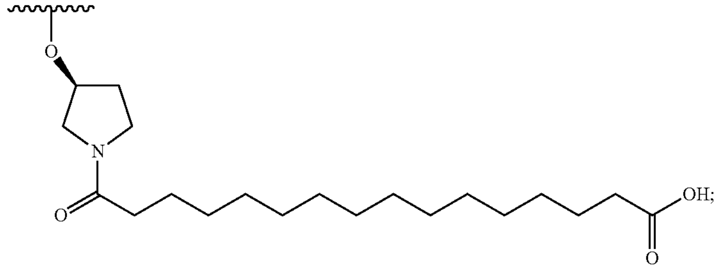
;
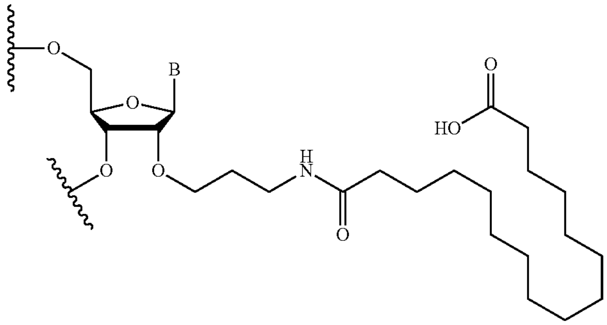
;
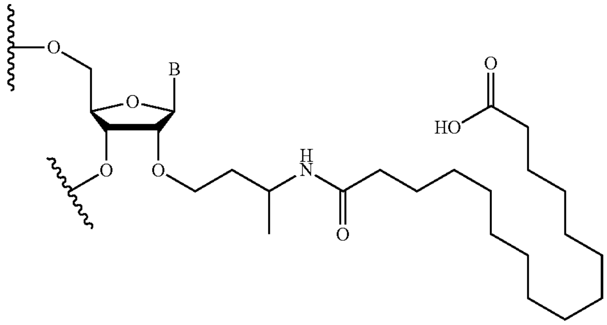
;
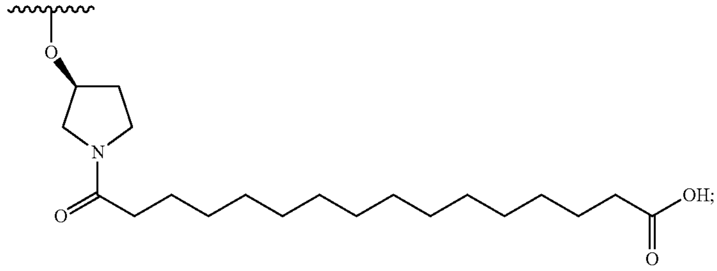
;

-continued
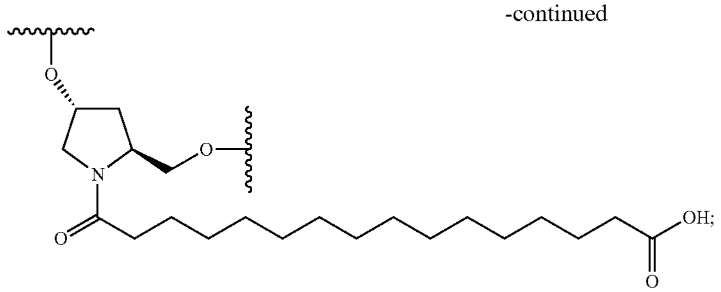
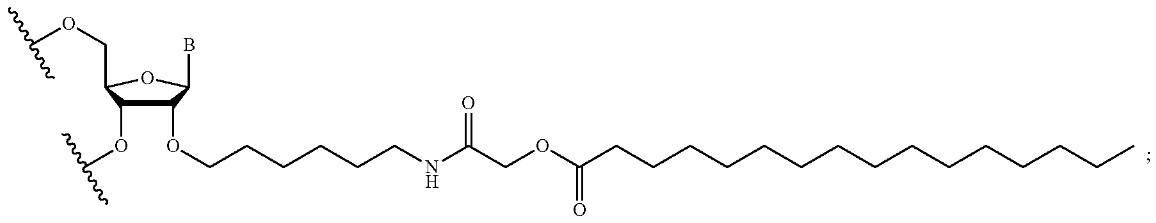
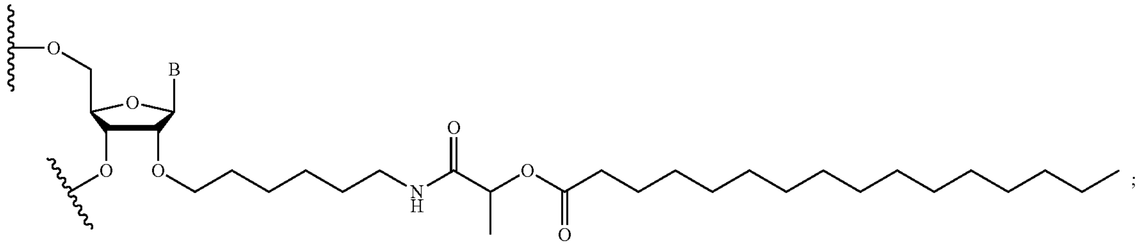
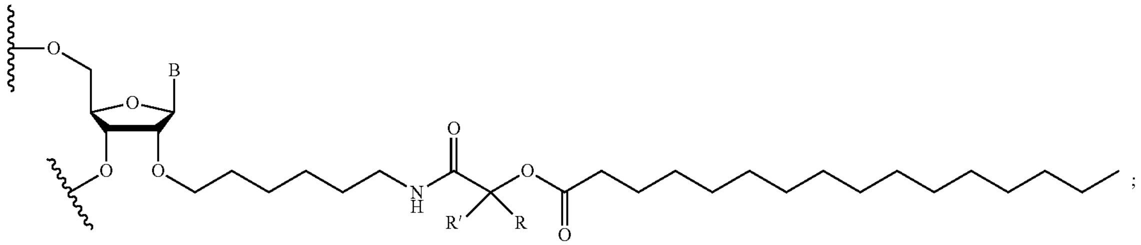
R, R′ = H or $CH_3$, Ethyl, isopropyl, tButyl
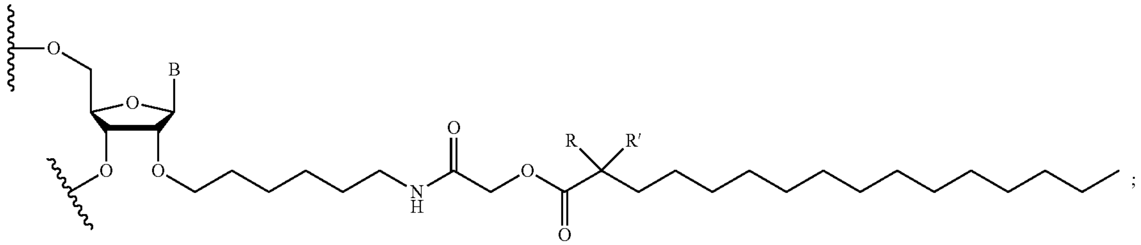
R, R′ = H or $CH_3$, Ethyl, isopropyl, tButyl
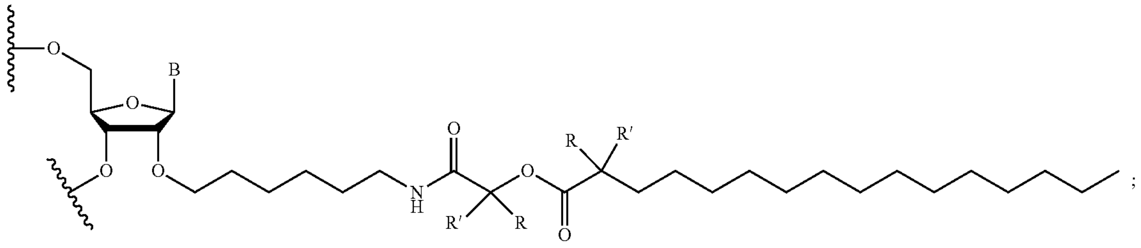
R, R′ = H or $CH_3$, Ethyl, isopropyl, tButyl -continued
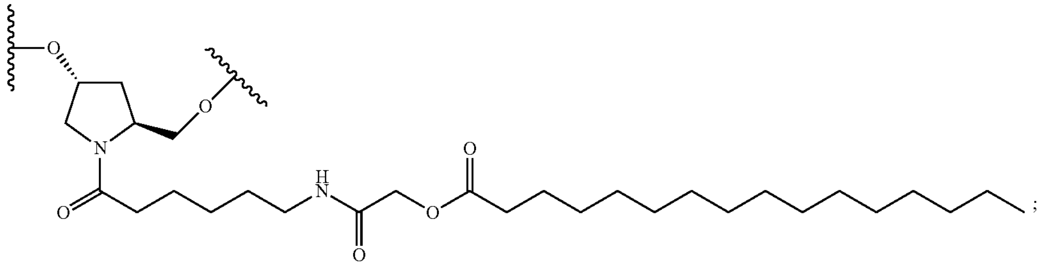
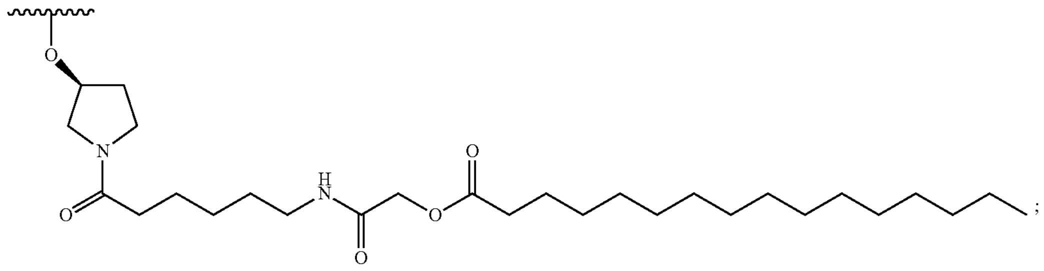
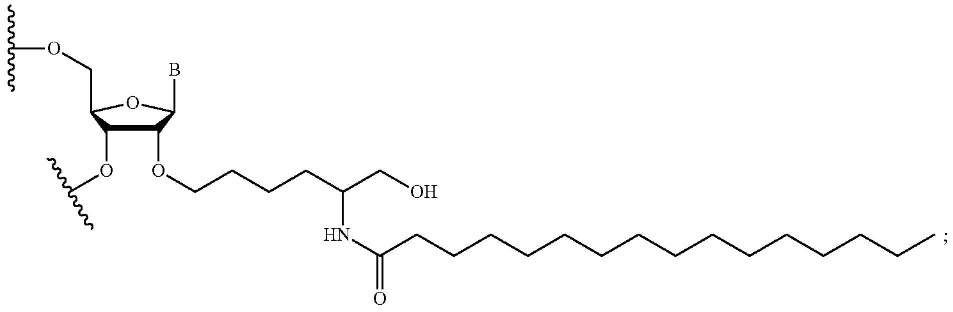
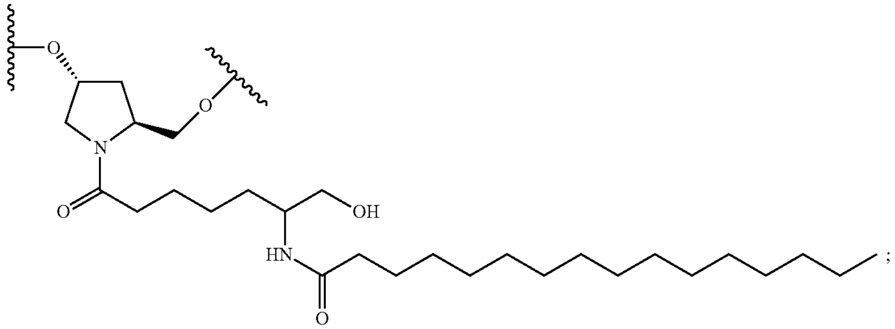
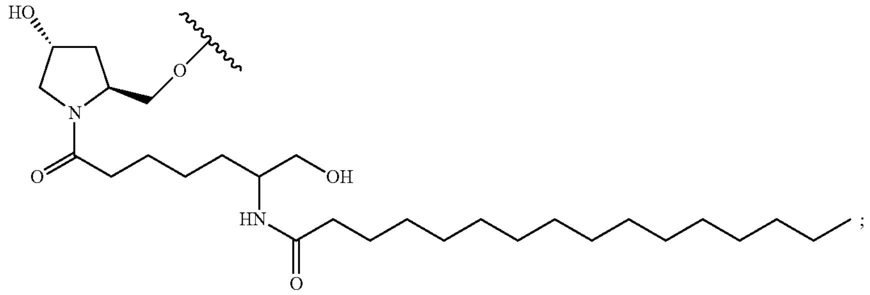

-continued

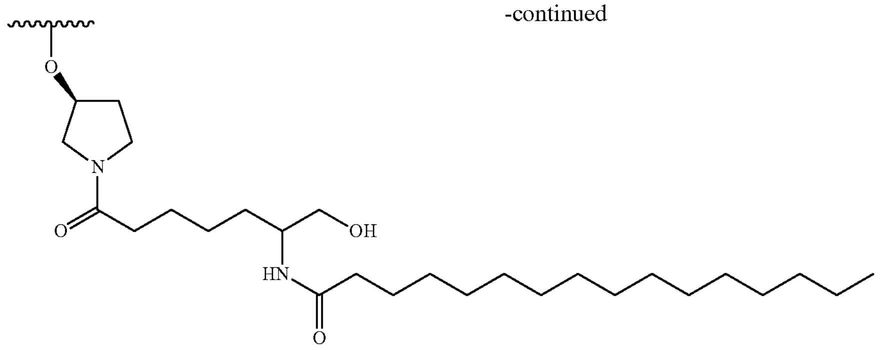

; and

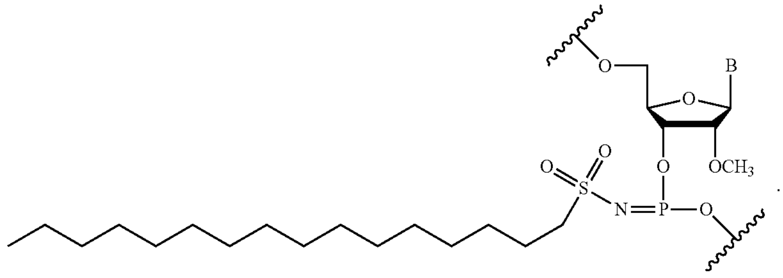

In one embodiment, a lipophilic monomer comprises a lipophilic moiety.

In one embodiment, the RNAi agent further comprises at least one modified nucleotide.

In one embodiment, substantially all of the nucleotides of the sense strand comprise a modification; substantially all of the nucleotides of the antisense strand comprise a modification; or substantially all of the nucleotides of the sense strand and substantially all of the nucleotides of the antisense strand comprise a modification.

In one embodiment, all of the nucleotides of the sense strand comprise a modification; all of the nucleotides of the antisense strand comprise a modification; or all of the nucleotides of the sense strand and all of the nucleotides of the antisense strand comprise a modification.

In one embodiment, at least one of the modified nucleotides is selected from the group consisting of a deoxy-nucleotide, a 3'-terminal deoxythymidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a thermally destabilizing nucleotide, a glycol modified nucleotide (GNA), and a 2-O—(N-methylacetamide) modified nucleotide; and combinations thereof.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and glycol; and combinations thereof.

In another embodiment, at least one of the modified nucleotides is selected from the group consisting of a deoxy-nucleotide, a 2'-O-methyl modified nucleotide, a 2'-fluoro modified nucleotide, a 2'-deoxy-modified nucleotide, a glycol modified nucleotide (GNA), and, a vinyl-phosphonate nucleotide; and combinations thereof.

In one embodiment, at least one of the modifications on the nucleotides is a thermally destabilizing nucleotide modification.

In one embodiment, the thermally destabilizing nucleotide modification is selected from the group consisting of an abasic modification; a mismatch with the opposing nucleotide in the duplex; and destabilizing sugar modification, a 2'-deoxy modification, an acyclic nucleotide, an unlocked nucleic acids (UNA), and a glycerol nucleic acid (GNA).

The double stranded region may be 19-30 nucleotide pairs in length; 19-25 nucleotide pairs in length; 19-23 nucleotide pairs in length; 23-27 nucleotide pairs in length; or 21-23 nucleotide pairs in length.

In one embodiment, each strand is independently no more than 30 nucleotides in length.

In one embodiment, the sense strand is 21 nucleotides in length and the antisense strand is 23 nucleotides in length.

The region complementarity to part of the mRNA may be at least 17 nucleotides in length; between 19 and 23 nucleotides in length; or 19 nucleotides in length.

In one embodiment, at least one strand comprises a 3' overhang of at least 1 nucleotide.

In another embodiment, at least one strand comprises a 3' overhang of at least 2 nucleotides.

In one embodiment, the RNAi agent further comprises at least one phosphorothioate or methylphosphonate internucleotide linkage.

In one embodiment, the phosphorothioate or methylphosphonate internucleotide linkage is at the 3'-terminus of one strand.

In one embodiment, the strand is the antisense strand.

In another embodiment, the strand is the sense strand.

In one embodiment, the phosphorothioate or methylphosphonate internucleotide linkage is at the 5'-terminus of one strand.

In one embodiment, the strand is the antisense strand.

In another embodiment, the strand is the sense strand.

In one embodiment, the phosphorothioate or methylphosphonate internucleotide linkage is at the both the 5'- and 3'-terminus of one strand.

In one embodiment, the strand is the antisense strand.

In one embodiment, the double stranded RNAi agent further comprises a phosphate or phosphate mimic at the 5'-end of the antisense strand.

In one embodiment, the phosphate mimic is a 5'-vinyl phosphonate (VP).

In one embodiment, the antisense comprises at least one GNA in a seed region.

In one embodiment, the seed region is at position 5-7 from the 5'-end of the antisense strand.

In one embodiment, the antisense comprises at a GNA at position 7 from the 5'-end of the antisense strand.

In one embodiment, the double stranded RNAi agent further comprises a targeting ligand that targets a receptor which mediates delivery to an ocular tissue.

In another embodiment, the double stranded RNAi agent further comprises a targeting ligand that targets a receptor which mediates delivery to a neural tissue.

In one embodiment, the targeting ligand is selected from the group consisting of trans-retinol, RGD peptide, LDL receptor ligand, and carbohydrate based ligands.

In one embodiment, the RGD peptide is H-Gly-Arg-Gly-Asp-Ser-Pro-Lys-Cys-OH (SEQ ID NO: 14) or Cyclo(-Arg-Gly-Asp-D-Phe-Cys).

In one embodiment, the base pair at the 1 position of the 5'-end of the antisense strand of the duplex is an AU base pair.

In one embodiment, the lipophilic monomer is represented by the following formulae

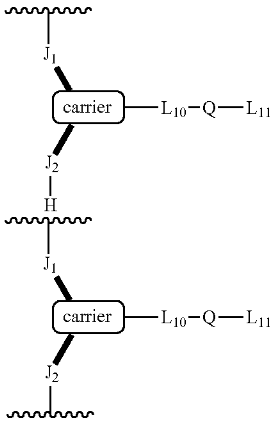

$J_1$ and $J_2$ are each independently O, S, $NR^N$, optionally substituted alkyl, OC(O)NH, NHC(O)O, C(O)NH, NHC(O), OC(O), C(O)O, OC(O)O, NHC(O)NH, NHC(S)NH, OC(S)NH, $OP(N(R^P)_2)O$, or $OP(N(R^P)_2)$;

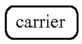

is a cyclic group or an acyclic group;

$R^N$ is H, optionally substituted alkyl, optionally substituted alkenyl, optionally substituted alkynyl, optionally substituted aryl, optionally substituted cycloalkyl, optionally substituted aralkyl, optionally substituted heteroaryl, or an amino protecting group;

$R^P$ is independently H, optionally substituted alkyl, optionally substituted alkenyl, optionally substituted alkynyl, optionally substituted aryl, optionally substituted cycloalkyl, or optionally substituted heteroaryl;

$L_{10}$ is C3-C8 substituted or unsubstituted alkyl, alkenyl, or alkynyl;

$L_{11}$ is C6-C26 substituted or unsubstituted alkyl, alkenyl, or alkynyl;

Q is absent when there is no nucleobase or a cleavable group that will cleave $L_{10}$ from $L_{11}$ at least 10 to 70% in vivo. In some embodiments, 15 to 50%, 20-40%, or 20 to 30% in vivo. For example, such group includes OC(O)—, —C(O)O—, —SC(O)—, —C(O)S—, —OC(S)—, —C(S)O—, —S—S—, —C($R^5$)═N—, —N═C($R^5$)—, —C($R^5$)═N—O—, —O—N═C($R^5$)—, —C(O)($NR^5$)—, —N($R^5$)C(O)—, —C(S)($NR^5$)—, —N($R^5$)C(O)—, —N($R^5$)C(O)N($R^5$)—, —OC(O)O—, —OSi$(R^5)_2$O—, —C(O)($CR^3R^4$)C(O)O—, —OC(O)($CR^3R^4$)C(O)—, or

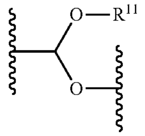

wherein $R^{11}$ is a $C_2$-$C_8$ alkyl or alkenyl; and each occurrence of $R^5$ is, independently, H or $C_1$-$C_4$ alkyl.

In one embodiment, the cleavability of Q is determined by stability of ligands in cerebral spinal fluid (CSF), stability of ligands in plasma, stability of ligands in brain homogenate, tissue homogenate (liver, ocular etc.) or stability of ligands in vitreous humor.

In one embodiment, the acyclic group is is a serinol, glycerol, or diethanolamine.

In one embodiment, the cyclic group is selected from the group consisting of pyrrolidinyl, hydroxyprolinyl, cyclopentyl, cyclohexyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decaliny.

In one embodiment, the cyclic group is a ribose or a ribose analog. Examples of ribose analogs include arabinose, 4'-thio ribose, 2'-O-methyl ribose, GNA, UNA, and LNA analogs.

It is understood that the antisense strand has sufficient complementarity to a complement component C3 gene sequence to mediate RNA interference. In other words, the dsRNAi agents of the invention are capable of inhibiting the expression of a complement component C3 gene.

In one embodiment, the dsRNAi agent can comprise one or more non-natural nucleotides. For example, the dsRNAi agent can comprise less than 20%, e.g., less than 15%, less than 10%, or less than 5% non-natural nucleotides, or the dsRNAi agent comprises no non-natural nucleotides. For example, the dsRNAi agent comprises all natural nucleotides. Some exemplary non-natural nucleotides include, but are not limited to, acyclic nucleotides, locked nucleic acid (LNA), HNA, CeNA, 2'-methoxyethyl, 2'-O-allyl, 2'-C-allyl, 2'-fluoro, 2'-O—N-methylacetamido (2'-O—NMA), a 2'-O-dimethylaminoethoxyethyl (2'-O-DMAEOE), 2-O-aminopropyl (2-O-AP), and 2'-ara-F.

In one embodiment, when the dsRNAi agent comprises less than 8 non-2'OMe nucleotides, the antisense stand comprises at least one DNA. For example, in any one of the embodiments of the invention when the dsRNAi agent comprises less than 8 non-2'OMe nucleotides, the antisense stand comprises at least one DNA.

In another aspect, the invention further provides a method for delivering the dsRNAi agent of the invention to a specific target in a subject by subcutaneous or intravenous administration. The invention further provides the dsRNAi agent of the invention for use in a method for delivering said agents to a specific target in a subject by subcutaneous or intravenous administration.

In one aspect, the present invention provides a double stranded RNAi agent comprising a sense strand and an antisense strand forming a double stranded region, wherein the antisense strand comprises a region complementary to part of an mRNA encoding a complement component C3 gene, wherein each strand independently has 14 to 30 nucleotides, wherein the double stranded RNAi agent is represented by formula (III):

sense: 5' *np*-Na—(X X X)*i*-Nb—Y Y Y—Nb—(Z Z Z)*j*-Na-*nq* 3' antisense: 3' *np*'-Na'—(X'X'X')*k*-Nb'—Y'Y'Y'—Nb'—(Z'Z'Z')*l*-Na'-*nq*' 5' (III)

wherein i, j, k, and l are each independently 0 or 1, provided that at least one of i, j, k, and l is 1; p, p', q, and q' are each independently 0-6; each Na and Na' independently represents an oligonucleotide sequence comprising 2-20 nucleotides which are modified, each sequence comprising at least two differently modified nucleotides; each Nb and Nb' independently represents an oligonucleotide sequence comprising 1-10 nucleotides which are modified; each np, np', nq, and nq' independently represents an overhang nucleotide; XXX, YYY, ZZZ, X'X'X', Y'Y'Y', and Z'Z'Z' each independently represent one motif of three identical modifications on three consecutive nucleotides; and wherein one or more lipophilic moieties are conjugated to one or more internal positions on at least one strand.

In certain embodiments, the lipophilic moiety is conjugated to position 20, position 15, position 7, position 6, or position 2 of the sense strand (counting from the 5' end of the strand) or position 16 of the antisense strand (counting from the 5' end of the strand). In certain embodiments, the lipophilic moiety is conjugated to position 20, position 15, or position 7 of the sense strand (counting from the 5' end of the strand). In certain embodiments, the lipophilic moiety is conjugated to position 20 or position 15 of the sense strand (counting from the 5' end of the strand). In certain embodiments, the lipophilic moiety is conjugated to position 16 of the antisense strand (counting from the 5' end of the strand).

In certain embodiments, the one or more lipophilic moieties are conjugated to one or more internal positions on at least one strand of the double stranded RNAi agent via a linker or carrier, e.g., in certain embodiments, the one or more lipophilic moieties are conjugated to one or more positions on at least one strand within the double stranded region via a linker or carrier.

In certain embodiments, the lipophilicity of the lipophilic moiety, measured by log Kow, exceeds 0.

In certain embodiments, the hydrophobicity of the double-stranded iRNA agent, measured by the unbound fraction in the plasma protein binding assay of the double-stranded iRNA agent, exceeds 0.2.

In certain embodiments, the plasma protein binding assay is an electrophoretic mobility shift assay using human serum albumin protein.

In certain embodiments, the internal positions include all positions except the terminal two positions from each end of the at least one strand of the double stranded RNAi agent.

In certain embodiments, the internal positions include all positions except the terminal three positions from each end of the at least one strand of the double stranded RNAi agent.

In certain embodiments, the internal positions exclude a cleavage site region of the sense strand of the double stranded RNAi agent. In certain embodiments, the positions within the double stranded region exclude a cleavage site region of the sense strand of the double stranded RNAi agent.

In certain embodiments, the internal positions include all positions except positions 9-12, counting from the 5'-end of the sense strand of the double stranded RNAi agent.

In certain embodiments, the internal positions include all positions except positions 11-13, counting from the 3'-end of the sense strand of the double stranded RNAi agent.

In certain embodiments, the internal positions exclude a cleavage site region of the antisense strand of the double stranded RNAi agent.

In certain embodiments, the internal positions include all positions except positions 12-14, counting from the 5'-end of the antisense strand of the double stranded RNAi agent.

In certain embodiments, the internal positions include all positions except positions 11-13 on the sense strand of the double stranded RNAi agent, counting from the 3'-end, and positions 12-14 on the antisense strand of the RNAi agent, counting from the 5'-end.

In certain embodiments, the one or more lipophilic moieties are conjugated to one or more of the internal positions selected from the group consisting of positions 4-8 and 13-18 on the sense strand, and positions 6-10 and 15-18 on the antisense strand, counting from the 5'end of each strand of the RNAi agent.

In certain embodiments, the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand of the RNAi agent.

In certain embodiments, the lipophilic moiety is an aliphatic, alicyclic, or polyalicyclic compound.

In certain embodiments, the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine.

In certain embodiments, the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.

In certain embodiments, the lipophilic moiety contains a saturated or unsaturated C6-C18 hydrocarbon chain.

In certain embodiments, the lipophilic moiety contains a saturated or unsaturated C16 hydrocarbon chain.

In certain embodiments, the saturated or unsaturated C16 hydrocarbon chain is conjugated to position 6, counting from the 5'-end of the strand on the double stranded RNAi agent. In certain embodiments, the saturated or unsaturated C16 hydrocarbon chain is conjugated to position 6, counting from the 5'-end of the sense strand on the double stranded RNAi agent.

In certain embodiments, the lipophilic moiety is conjugated via a carrier that replaces one or more nucleotide(s) in the internal position(s) on the strand of the double stranded RNAi agent. In certain embodiments, the lipophilic moiety is conjugated via a carrier that replaces one or more nucleotide(s) in the double stranded region.

In certain embodiments, the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.

In certain embodiments, the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction, or carbamate.

In certain embodiments, the lipophilic moiety is conjugated to a nucleobase, sugar moiety, or internucleosidic linkage.

In certain embodiments, the double stranded RNAi agent further comprises a ligand that mediates delivery to an ocular tissue.

In other embodiments, the double stranded RNAi agent further comprises a ligand that mediates delivery to a neural tissue.

In some embodiments, the ligand that mediates delivery to the ocular tissue is a targeting ligand that targets a receptor which mediates delivery to the ocular tissue.

In some embodiments, the ligand that mediates delivery to the neural tissue is a targeting ligand that targets a receptor which mediates delivery to the neural tissue.

In certain embodiments, the targeting ligand is selected from the group consisting of trans-retinol, RGD peptide, LDL receptor ligand, and carbohydrate based ligands.

In certain embodiments, the RGD peptide is H-Gly-Arg-Gly-Asp-Ser-Pro-Lys-Cys-OH (SEQ ID NO: 14) or Cyclo (-Arg-Gly-Asp-D-Phe-Cys).

In certain embodiments, the double stranded RNAi agent further comprises a targeting ligand that targets a liver tissue.

In certain embodiments, the targeting ligand is a GalNAc conjugate. In certain embodiments, the GalNAc conjugate is one or more GalNAc derivatives, optionally conjugated to the double stranded RNAi agent via a linker or carrier. one or more GalNAc derivatives, optionally conjugated to the double stranded RNAi agent via a linker or carrier. In certain embodiments, one of the modified strands in Tables 3, 5, 7, and 9 are conjugated to a targeting ligand that targets a liver tissue. In certain embodiments, the targeting ligand is an L96 ligand, e.g., one or more GalNAc derivatives, optionally conjugated to the double stranded RNAi agent via a linker or carrier. In certain embodiments, the L96 ligand is conjugated to the end of one of the strands. In certain embodiments the L96 ligand is conjugated to the 3' end of the sense strand.

In certain embodiments, the lipophilic moeity or targeting ligand is conjugated to the double stranded RNAi agent via a bio-cleavable linker selected from the group consisting of DNA, RNA, disulfide, amide, functionalized monosaccharides or oligosaccharides of galactosamine, glucosamine, glucose, galactose, mannose, and combinations thereof.

In certain embodiments, the 3' end of the sense strand of the double stranded RNAi agent is protected via an end cap which is a cyclic group having an amine, the cyclic group being selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl.

In certain embodiments, the RNAi agent comprises a terminal, chiral modification occurring at the first internucleotide linkage at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp configuration or Sp configuration.

In certain embodiments, the RNAi agent comprises a terminal, chiral modification occurring at the first and second internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In certain embodiments, the RNAi agent comprises a terminal, chiral modification occurring at the first, second and third internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In certain embodiments, the RNAi agent comprises a terminal, chiral modification occurring at the first, and second internucleotide linkages at the 3' end of the antisense strand, having the linkage phosphorus atom in Sp configuration, a terminal, chiral modification occurring at the third internucleotide linkages at the 3' end of the antisense strand, having the linkage phosphorus atom in Rp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In certain embodiments, the RNAi agent comprises a terminal, chiral modification occurring at the first, and second internucleotide linkages at the 3' end of the antisense strand, having the linkage phosphorus atom in Sp configuration, a terminal, chiral modification occurring at the first, and second internucleotide linkages at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In certain embodiments, the double stranded RNAi agent is represented by formula (III):

sense: 5' *np*-Na—(X X X)*i*-Nb—Y Y Y—Nb—(Z Z Z)*j*-Na-*nq* 3' antisense: 3' *np*'-Na'—(X'X'X')*k*-Nb'—Y'Y'Y'—Nb'—(Z'Z'Z')*l*-Na'-*nq*' 5' (III)

wherein j is 1 or 2; or wherein 1 is 1; or wherein both j and 1 are 1.

In certain embodiments, the double stranded RNAi agent is represented by formula (III):

sense: 5' *np*-Na—(X X X)*i*-Nb—Y Y Y—Nb—(Z Z Z)*j*-Na-*nq* 3' antisense: 3' *np*'-Na'—(X'X'X')*k*-Nb'—Y'Y'Y'—Nb'—(Z'Z'Z')*l*-Na'-*nq*' 5' (III)

wherein XXX is complementary to X'X'X', YYY is complementary to Y'Y'Y', and ZZZ is complementary to Z'Z'Z'.

In certain embodiments, the YYY motif occurs at or near the cleavage site of the sense strand of the double stranded RNAi agent; or wherein the Y'Y'Y' motif occurs at the 11, 12 and 13 positions of the antisense strand of the double stranded RNAi agent, from the 5'-end.

In some embodiment, formula (III) is represented as formula (IIIa):

sense: 5' *np*-Na—Y Y Y—Nb—Z Z Z—Na-*nq* 3' antisense: 3' *np*'-Na'—Y'Y'Y'—Nb'—Z'Z'Z'—Na'*nq*' 5' (IIIa)

wherein each Nb and Nb' independently represents an oligonucleotide sequence comprising 1-5 modified nucleotides; or formula (III) is represented as formula (IIIb):

sense: 5' *np*-Na—X X X—Nb—Y Y Y—Na-*nq* 3' antisense: 3' *np*'-Na'—X'X'X'—Nb'—Y'Y'Y'—Na'-*nq*' 5' (IIIb)

wherein each Nb and Nb' independently represents an oligonucleotide sequence comprising 1-5 modified nucleotides; or formula (III) is represented as formula (IIIc):

sense: 5' *np*-Na—X X X—Nb—Y Y Y—Nb—Z Z Z—Na-*nq* 3' antisense: 3' *np*'-Na'—X'X'X'—Nb'—Y'Y'Y'—Nb'—Z'Z'Z'—Na'-*nq*' 5' (IIIc)

wherein each Nb and Nb' independently represents an oligonucleotide sequence comprising 1-5 modified nucleotides and each Na and Na' independently represents an oligonucleotide sequence comprising 2-10 modified nucleotides.

In certain embodiments, the modifications on the nucleotides of the double stranded RNAi agent are selected from the group consisting of a deoxy-nucleotide, a 3'-terminal deoxythymidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic, and combinations thereof.

In certain embodiments, the modifications on the nucleotides are 2'-O-methyl, 2'-fluoro or both.

In certain embodiments, the Y of formula (III) is 2'-O-methyl.

In certain embodiments, the Z nucleotides of formula (III) contain a 2'-O-methyl modification.

In certain embodiments, the modifications on the Na, Na', Nb, and Nb' nucleotides of formula (III) are 2'-O-methyl, 2'-fluoro or both.

In certain embodiments, the sense strand and the antisense strand of the RNAi agent form a duplex region which is 15-30 nucleotide pairs in length.

In certain embodiments, the duplex region is 17-25 nucleotide pairs in length.

In certain embodiments, the sense and antisense strands of the RNAi agent are each independently 15 to 30 nucleotides in length.

In certain embodiments, the sense and antisense strands of the RNAi agent are each independently 19 to 25 nucleotides in length.

In certain embodiments, each of the sense strand and the antisense strand of the RNAi agent independently have 21 to 23 nucleotides.

In certain embodiments, the sense strand of the RNAi agent has a total of 21 nucleotides and the antisense strand of the RNAi agent has a total of 23 nucleotides.

In certain embodiments, the RNAi agent further comprises at least one phosphorothioate or methylphosphonate internucleotide linkage.

In certain embodiments, the phosphorothioate or methylphosphonate internucleotide linkage is at the 3'-terminal of one strand.

In certain embodiments, the phosphorothioate or methylphosphonate internucleotide linkage is at the 3'-terminal of the antisense strand. In certain embodiments, the double stranded RNAi agent is represented by formula (III), wherein p'=2.

In certain embodiments, the double stranded RNAi agent is represented by formula (III), wherein at least one $n_p$' is linked to a neighboring nucleotide via a phosphorothioate linkage.

In certain embodiments, the double stranded RNAi agent is represented by formula (III), wherein all $n_p$' are linked to neighboring nucleotides via phosphorothioate linkages.

In certain embodiments, the double stranded RNAi agent further comprises a phosphate or phosphate mimic at the 5'-end of the antisense strand.

In certain embodiments, the phosphate mimic is a 5'-vinyl phosphonate (VP).

In certain embodiments, the base pair at the 1 position of the 5'-end of the antisense strand of the double stranded RNAi duplex is an AU base pair.

Another aspect of the instant disclosure provides a cell containing a double stranded RNAi agent of the instant disclosure.

An additional aspect of the instant disclosure provides a pharmaceutical composition for inhibiting expression of a C3 gene that includes a double stranded RNAi agent of the instant disclosure.

In one embodiment, the double stranded RNAi agent is administered in an unbuffered solution. Optionally, the unbuffered solution is saline or water.

In another embodiment, the double stranded RNAi agent is administered with a buffer solution. Optionally, the buffer solution includes acetate, citrate, prolamine, carbonate, or phosphate or any combination thereof. In another embodiment, the buffer solution is phosphate buffered saline (PBS).

Another aspect of the disclosure provides a pharmaceutical composition that includes a double stranded RNAi agent of the instant disclosure and a lipid formulation.

In one embodiment, the lipid formulation includes a lipid nanoparticle (LNP).

An additional aspect of the disclosure provides a method of inhibiting expression of a C3 gene in a cell, such as a neural cell or an ocular cell, the method involving: (a) contacting the cell with a double stranded RNAi agent of the instant disclosure or a pharmaceutical composition of the instant disclosure; and (b) maintaining the cell produced in step (a) for a time sufficient to obtain degradation of the mRNA transcript of a C3 gene, thereby inhibiting expression of the C3 gene in the cell.

In one embodiment, the cell is within a subject. Optionally, the subject is a human.

In certain embodiments, the subject is a rhesus monkey, a cynomolgous monkey, a mouse, or a rat.

In certain embodiments, the human subject suffers from a C3-associated neurodegenerative disease, e.g., an amyloid-β-mediated disease, e.g., Alzheimer's disease (AD), Amyotrophic Lateral Sclerosis (ALS), schizophrenia, Parkinson's disease (PD), and prion diseases, such as Creutzfeldt-Jakob disease (CJD).

In certain embodiments, the subject suffers from complement component C3-associated ocular disease, e.g., a C3-associated ocular disease or disorder selected from the group consisting of C3-associated aged-related macular degeneration (AMD), C3-associated basal laminar drusen (BLD), C3-associated diabetic retinopathy (DR), C3-associated diabetic macular edema (DME) and C3-associated retinal vein occlusion (RVO).

In certain embodiments, the double stranded RNAi agent is administered at a dose of about 0.01 mg/kg to about 50 mg/kg.

In some embodiments, the double stranded RNAi agent is administered to the subject intrathecally.

In certain embodiments, the double stranded RNAi agent is administered to the subject via periocular, conjunctival, subtenon, intracameral, intravitreal, intraocular, anterior or posterior juxtascleral, subretinal, subconjunctival, retrobulbar, or intracanalicular administration.

In one embodiment, the method reduces the expression of a C3 gene in a brain (e.g., striatum) or spine tissue. Optionally, the brain or spine tissue is striatum, cortex, cerebellum, cervical spine, lumbar spine, or thoracic spine.

In certain embodiments, the administration of the double stranded RNAi agent to the subject reduces C3-mediated neovascularization in the choroid or the retina of subject's eye.

In some embodiments, the double stranded RNAi agent is administered to the subject subcutaneously.

In one embodiment, the method reduces the expression of a C3 gene in the liver.

In other embodiments, the method reduces the expression of a C3 gene in the liver and the brain.

In other embodiments, the method reduces the expression of a C3 gene in the liver and the ocular tissue.

In certain embodiments, the double stranded RNAi agent is chronically administered to the human subject.

Another aspect of the instant disclosure provides a method of inhibiting the expression of C3 in a subject, the method involving: administering to the subject a therapeutically effective amount of a double stranded RNAi agent of the disclosure or a pharmaceutical composition of the disclosure, thereby inhibiting the expression of C3 in the subject.

An additional aspect of the disclosure provides a method for treating or preventing a disorder or C3-associated neurodegenerative disease or disorder in a subject, the method involving administering to the subject a therapeutically effective amount of a double stranded RNAi agent of the disclosure or a pharmaceutical composition of the disclosure, thereby treating or preventing a C3-associated neurodegenerative disease or disorder in the subject.

In certain embodiments, the C3-associated neurodegenerative disease or disorder is selected from the group consisting of Alzheimer's disease (AD), Amyotrophic Lateral Sclerosis (ALS), schizophrenia, Parkinson's disease (PD), and prion diseases, such as Creutzfeldt-Jakob disease (CJD).

In yet another aspect, the present invention provides a method of treating a subject suffering from a complement component C3-associated ocular disease, comprising administering to the subject a therapeutically effective amount of a double stranded RNAi agent of the invention.

In certain embodiments, the C3-associated ocular disease or disorder is selected from the group consisting of C3-associated aged-related macular degeneration (AMD), C3-associated basal laminar drusen (BLD), C3-associated diabetic retinopathy (DR), C3-associated diabetic macular edema (DME) and C3-associated retinal vein occlusion (RVO).

In certain embodiments, the method further involves administering an additional therapeutic agent or therapy to the subject.

Exemplary additional therapeutics and treatments include, for example, sedatives, antidepressants, clonazepam, sodium valproate, opiates, antiepileptic drugs, cholinesterase inhibitors, memantine, benzodiazepines, levodopa, COMT inhibitors (e.g., tolcapone and entacapone), dopamine agonists (e.g., bromocriptine, pergolide, pramipexole, ropinirole, piribedil, cabergoline, apomorphine and lisuride), MAO-B inhibitors (e.g., safinamide, selegiline and rasagiline), amantadine, an anticholinergic, modafinil, pimavanserin, doxepin, rasagline, an antipsychotic, an atypical antipsychotic (e.g., amisulpride, olanzapine, risperidone, and clozapine), riluzole, edaravone, deep brain stimulation, non-invasive ventilation (NIV), invasive ventilation physical therapy, occupational therapy, speech therapy, dietary changes and swallowing technique a feeding tube, a PEG tube, probiotics, and psychological therapy.

Another aspect of the instant disclosure provides a kit for performing a method of the instant disclosure, the kit including: a) a double stranded RNAi agent of the instant disclosure, and b) instructions for use, and c) optionally, a device for administering the double stranded RNAi agent to the subject.

In yet another aspect, the present invention provides a method of treating a subject suffering from a complement component C3-associated ocular disease, comprising administering to the subject a therapeutically effective amount of a double stranded RNAi agent of the invention.

The present invention is further illustrated by the following detailed description and drawings.

BRIEF DESCRIPTION OF THE DRAWINGS

FIG. 1 schematically depicts the three complement pathways: alternative, classical and lectin.

DETAILED DESCRIPTION OF THE INVENTION

The present invention is based, at least in part, on the discovery that conjugating a lipophilic monomer, such as a lipohilic moiety, to a double-stranded iRNA agent targeting complement component C3, provides surprisingly good results for in vivo intraocular or intrathecal delivery of the double-stranded iRNAs, resulting in efficient entry into ocular tissues and efficient internalization into cells of the ocular system or efficient entry into neural tissues and efficient internalization into cells of the neural system. The lipophilic monomer may be, for example, conjugated to one or more positions on at least one strand of a double-stranded iRNA agent targeting complement component C3.

Accordingly, the present disclosure provides RNAi agent compositions which effect the RNA-induced silencing complex (RISC)-mediated cleavage of RNA transcripts of a complement component C3 (C3) gene. The C3 gene may be within a cell, e.g., a cell within a subject, such as a human. The present disclosure also provides methods of using the RNAi agent compositions of the disclosure for inhibiting the expression of a C3 gene or for treating a subject who would benefit from inhibiting or reducing the expression of a C3 gene, e.g., a subject suffering or prone to suffering from a complement component C3-associated neurodegenerative disease, e.g., Alzheimer's disease (AD), Amyotrophic Lateral Sclerosis (ALS), schizophrenia, Parkinson's disease (PD), and prion diseases, such as Creutzfeldt-Jakob disease (CJD) or a complement component C3-associated ocular disease, e.g., dry macular degeneration, wet macular degeneration, Basal Laminar drusen, diabetic retinopathy, diabetic macular edema.

The RNAi agents of the disclosure include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a C3 gene. In certain embodiments, the RNAi agents of the disclosure include an RNA strand (the antisense strand) having a region which is about 21-23 nucleotides in length, which region is substantially complementary to at least part of an mRNA transcript of a C3 gene.

In certain embodiments, the RNAi agents of the disclosure include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of a C3 gene. These RNAi agents with the longer length antisense strands may, for example, include a second RNA strand (the sense strand) of 20-60 nucleotides in length wherein the sense and antisense strands form a duplex of 18-30 contiguous nucleotides.

The use of these RNAi agents enables the targeted degradation of mRNAs of a C3 gene in mammals. Thus, methods and compositions including these RNAi agents are useful for treating a subject who would benefit by a reduction in the levels or activity of a C3 protein, such as a subject having a C3-associated neurodegenerative disease, e.g. an amyloid-β-mediated disease, such as Alzherimer's disease, or a complement component C3-associated ocular disease, e.g., dry macular degeneration, wet macular degeneration, Basal Laminar drusen, diabetic retinopathy, diabetic macular edema.

The following detailed description discloses how to make and use compositions containing iRNAs to selectively inhibit the expression of a complement component C3 gene in an ocular cell or a neural cell, as well as compositions, uses, and methods for treating subjects having C3-associated ocular diseases and disorders or subjects having complement component C3-associated neurodegenerative diseases and disorders that would benefit from inhibition or reduction of the expression of a complement component C3 gene in an ocular cell or a neural cell.

I. DEFINITIONS

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise.

The term "about" is used herein to mean within the typical ranges of tolerances in the art. For example, "about" can be understood as within about 2 standard deviations from the mean. In certain embodiments, about means +10%. In certain embodiments, about means +5%. When about is present before a series of numbers or a range, it is understood that "about" can modify each of the numbers in the series or range.

The term "at least" "no less than", or "or more" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between a sequence and its indicated site on a transcript or other sequence, the nucleotide sequence recited in the specification takes precedence.

In the event of a conflict between a chemical structure and a chemical name, the chemical structure takes precedence.

As used herein, the term "Complement Component 3," used interchangeably with the term "C3," refers to the well-known gene and polypeptide, also known in the art as ARMD9, C3a Anaphylatoxin, ASP, Complement Component C3a, C3a, Complement Component C3b, C3b, prepro-C3, Acylation-Stimulating Protein Cleavage Product, CPAMD1, Complement C3, C3 And PZP-Like Alpha-2-Macroglobulin Domain-Containing Protein 1, Complement Component C3, and AHUS5. The term "C3" includes human C3, the amino acid and nucleotide sequence of which may be found in, for example, GenBank Accession No. NM_000064.3 (GI:726965399; SEQ ID NO:1); mouse C3, the amino acid and nucleotide sequence of which may be found in, for example, GenBank Accession No. NM_009778.3 (GI:773669943; SEQ ID NO:2); and rat C3, the amino acid and nucleotide sequence of which may be found in, for example, GenBank Accession No. NM_016994.2 (GI:158138560; SEQ ID NO:3).

The term "C3" also includes *Macaca fascicularis* C3, the amino acid and nucleotide sequence of which may be found in, for example, GenBank Accession No. XM_005587719.2 (GI:982312947; SEQ ID NO:4) and in the entry for the gene, ENSP00000245907 (locus=chr19:6921416:6963034), in the *Macaca* genome project web site (http://macaque.genomics.org.cn/page/species/index.jsp).

Additional examples of C3 mRNA sequences are readily available using, e.g., GenBank, UniProt, OMIM, and the *Macaca* genome project web site.

Exemplary C3 nucleotide sequences may also be found in SEQ ID NOs:1-8. SEQ ID NOs:5-8 are the reverse complement sequences of SEQ ID NOs:1-4, respectively.

Further information on C3 is provided, for example in the NCBI Gene database at www.ncbi.nlm.nib.gov/gene/718.

The entire contents of each of the foregoing GenBank Accession numbers and the Gene database numbers are incorporated herein by reference as of the date of filing this application.

The terms "complement component C3" and "C3," as used herein, also refers to naturally occurring DNA sequence variations of the C3 gene. Numerous sequence variations within the C3 gene have been identified and may be found at, for example, NCBI dbSNP and UniProt (see, e.g., www.ncbi.nlm.nih.gov/snp?LinkName=gene_snp&from_uid=718, the entire contents of which is incorporated herein by reference as of the date of filing this application.

As used herein, "target sequence" refers to a contiguous portion of the nucleotide sequence of an mRNA molecule formed during the transcription of a complement component C3 gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a C3 gene. In one embodiment, the target sequence is within the protein coding region of the C3 gene. In another embodiment, the target sequence is within the 3' UTR of the C3 gene.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In some embodiments, the target sequence is about 19 to about 30 nucleotides in length. In other embodiments, the target sequence is about 19 to about 25 nucleotides in length. In still other embodiments, the target sequence is about 19 to about 23 nucleotides in length. In some embodiments, the target sequence is about 21 to about 23 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA," "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a complement component C3 gene in a cell, e.g., a cell within a subject, such as a mammalian subject.

In one embodiment, an RNAi agent of the invention includes a single stranded RNA that interacts with a target RNA sequence, e.g., a complement component C3 target mRNA sequence, to direct the cleavage of the target RNA. Without wishing to be bound by theory it is believed that long double stranded RNA introduced into cells is broken down into double stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes these dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107: 309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded siRNA (ssRNA) (the antisense strand of an siRNA duplex) generated within a cell and which promotes the formation of a RISC complex to effect silencing of the target gene, i.e., a complement component C3 gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded RNA as described herein or as chemically modified by the methods described in Lima et al., (2012) *Cell* 150:883-894.

In another embodiment, an "iRNA" for use in the compositions, uses, and methods of the invention is a double stranded RNA and is referred to herein as a "double stranded RNAi agent," "double stranded RNA (dsRNA) molecule," "dsRNA agent," or "dsRNA". The term "dsRNA" refers to a complex of ribonucleic acid molecules, having a duplex structure comprising two anti-parallel and substantially complementary nucleic acid strands, referred to as having "sense" and "antisense" orientations with respect to a target RNA, i.e., a C3 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide or a modified nucleotide. In addition, as used in this specification, an "RNAi agent" may include ribonucleotides with chemical modifications; an RNAi agent may include substantial modifications at multiple nucleotides.

As used herein, the term "modified nucleotide" refers to a nucleotide having, independently, a modified sugar moiety, a modified internucleotide linkage, or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "RNAi agent" for the purposes of this specification and claims.

In certain embodiments of the instant disclosure, inclusion of a deoxy-nucleotide—which is acknowledged as a naturally occurring form of nucleotide—if present within a RNAi agent can be considered to constitute a modified nucleotide.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

In certain embodiment, the two strands of double-stranded oligomeric compound can be linked together. The two strands can be linked to each other at both ends, or at one end only. By linking at one end is meant that 5'-end of first strand is linked to the 3'-end of the second strand or 3'-end of first strand is linked to 5'-end of the second strand. When the two strands are linked to each other at both ends, 5'-end of first strand is linked to 3'-end of second strand and 3'-end of first strand is linked to 5'-end of second strand. The two strands can be linked together by an oligonucleotide linker including, but not limited to, (N)n; wherein N is independently a modified or unmodified nucleotide and n is 3-23. In some embodiments, n is 3-10, e.g., 3, 4, 5, 6, 7, 8, 9, or 10. In some embodiments, the oligonucleotide linker is selected from the group consisting of GNRA, (G)4, (U)4, and (dT)4, wherein N is a modified or unmodified nucleotide and R is a modified or unmodified purine nucleotide. Some of the nucleotides in the linker can be involved in base-pair interactions with other nucleotides in the linker. The two strands can also be linked together by a non-nucleosidic linker, e.g. a linker described herein. It will be appreciated by one of skill in the art that any oligonucleotide chemical modifications or variations describe herein can be used in the oligonucleotide linker.

Hairpin and dumbbell type oligomeric compounds will have a duplex region equal to or at least 14, 15, 15, 16, 17, 18, 19, 29, 21, 22, 23, 24, or 25 nucleotide pairs. The duplex region can be equal to or less than 200, 100, or 50, in length. In some embodiments, ranges for the duplex region are 15-30, 17 to 23, 19 to 23, and 19 to 21 nucleotides pairs in length.

The hairpin oligomeric compounds can have a single strand overhang or terminal unpaired region, in some embodiments at the 3', and in some embodiments on the antisense side of the hairpin. In some embodiments, the overhangs are 1-4, more generally 2-3 nucleotides in length.

The hairpin oligomeric compounds that can induce RNA interference are also referred to as "shRNA" herein.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In one embodiment, an RNAi agent of the invention is a dsRNA, each strand of which is 24-30 nucleotides in length, that interacts with a target RNA sequence, e.g., a C3 target mRNA sequence, to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188).

In one embodiment, an RNAi agent of the invention is a dsRNA agent, each strand of which comprises 19-23 nucleotides that interacts with a C3 RNA sequence to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). In one embodiment, an RNAi agent of the invention is a dsRNA of 24-30 nucleotides that interacts with a C3 RNA sequence to direct the cleavage of the target RNA.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment of the dsRNA, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNAi agent, i.e., no nucleotide overhang. A "blunt ended" RNAi agent is a dsRNA that is double stranded over its entire length, i.e., no nucleotide overhang at either end of the molecule. The RNAi agents of the invention include RNAi agents with nucleotide overhangs at one end (i.e., agents with one overhang and one blunt end) or with nucleotide overhangs at both ends.

The term "antisense strand" or "guide strand" refers to the strand of an iRNA, e.g., a dsRNA, which includes a region that is substantially complementary to a target sequence, e.g., a complement component C3 mRNA.

As used herein, the term "region of complementarity" refers to the region on the antisense strand that is substantially complementary to a sequence, for example a target sequence, e.g., a complement component C3 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA.

In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(s) is not in the seed region.

Thus, an RNAi agent as described herein can contain one or more mismatches to the target sequence. In one embodiment, a RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of a C3 gene, generally does not contain any mismatch within the central 13 nucleotides. The methods described herein or methods known in the art can be used to determine whether an RNAi agent containing a mismatch to a target sequence is effective in inhibiting the expression of a C3 gene. Consideration of the efficacy of RNAi agents with mismatches in inhibiting expression of a C3 gene is important, especially if the particular region of complementarity in a C3 gene is known to have polymorphic sequence variation within the population.

The term "sense strand," or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can be, for example, "stringent conditions", where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway, in vitro or in vivo. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogsteen base pairing.

The terms "complementary," "fully complementary" and "substantially complementary" herein can be used with respect to the base matching between the sense strand and the antisense strand of a dsRNA, or between two oligonucleotides or polynucleotides, such as the antisense strand of a RNAi agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a C3 gene). For example, a polynucleotide is complementary to at least a part of a C3 mRNA if the sequence is substantially complementary to a non-interrupted portion of an mRNA encoding a C3 gene.

Accordingly, in some embodiments, the antisense polynucleotides disclosed herein are fully complementary to the target C3 sequence.

In other embodiments, the antisense polynucleotides disclosed herein are substantially complementary to the target complement component C3 sequence and comprise a contiguous nucleotide sequence which is at least 80% complementary over its entire length to the equivalent region of the nucleotide sequence of any one of SEQ ID NOs:1-4, or a fragment of any one of SEQ ID NOs:1-4, such as about 85%, about 90%, about 95% complementary.

In other embodiments, the antisense polynucleotides disclosed herein are substantially complementary to the target C3 sequence and comprise a contiguous nucleotide sequence which is at least about 80% complementary over its entire length to any one of the sense strand nucleotide sequences in any one of any one of Tables 2-9, or a fragment of any one of the sense strand nucleotide sequences in any one of Tables 2-9, such as about 85%, about 90%, about 95% complementary.

In one embodiment, an RNAi agent of the disclosure includes a sense strand that is substantially complementary to an antisense polynucleotide which, in turn, is the same as a target C3 sequence, and wherein the sense strand polynucleotide comprises a contiguous nucleotide sequence which is at least about 80% complementary over its entire length to the equivalent region of the nucleotide sequence of SEQ ID NOs: 5-8, or a fragment of any one of SEQ ID NOs:5-8, such as about 85%, about 90%, about 95% complementary.

In some embodiments, an iRNA of the invention includes a sense strand that is substantially complementary to an antisense polynucleotide which, in turn, is complementary to a target complement component C3 sequence, and wherein the sense strand polynucleotide comprises a contiguous nucleotide sequence which is at least about 80% complementary over its entire length to any one of the antisense strand nucleotide sequences in any one of any one of Tables 2-9, or a fragment of any one of the antisense strand nucleotide sequences in any one of Tables 2-9, such as about 85%, about 90%, about 95% complementary.

In some embodiments, the double-stranded region of a double-stranded iRNA agent is equal to or at least, 10, 11, 12, 13, 14, 15, 16, 17, 18, 19, 20, 21, 22, 23, 23, 24, 25, 26, 27, 28, 29, 30 or more nucleotide pairs in length.

In some embodiments, the antisense strand of a double-stranded iRNA agent is equal to or at least 14, 15, 16, 17, 18, 19, 20, 21, 22, 23, 23, 24, 25, 26, 27, 28, 29, or 30 nucleotides in length.

In some embodiments, the sense strand of a double-stranded iRNA agent is equal to or at least 10, 11, 12, 13, 14, 15, 16, 17, 18, 19, 20, 21, 22, 23, 23, 24, 25, 26, 27, 28, 29, or 30 nucleotides in length.

In one embodiment, the sense and antisense strands of the double-stranded iRNA agent are each independently 15 to 30 nucleotides in length.

In one embodiment, the sense and antisense strands of the double-stranded iRNA agent are each independently 19 to 25 nucleotides in length.

In one embodiment, the sense and antisense strands of the double-stranded iRNA agent are each independently 21 to 23 nucleotides in length.

In one embodiment, the sense strand of the iRNA agent is 21-nucleotides in length, and the antisense strand is 23-nucleotides in length, wherein the strands form a double-stranded region of 21 consecutive base pairs having a 2-nucleotide long single stranded overhangs at the 3-end.

In one aspect of the invention, an agent for use in the methods and compositions of the invention is a single-stranded antisense nucleic acid molecule that inhibits a target mRNA via an antisense inhibition mechanism. The single-stranded antisense RNA molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense RNA molecule may be about 15 to about 30 nucleotides in length and have a sequence that is complementary to a target sequence. For example, the single-stranded antisense RNA molecule may comprise a sequence that is at least about 15, 16, 17, 18, 19, 20, or more contiguous nucleotides from any one of the antisense sequences described herein.

In one embodiment, at least partial suppression of the expression of a C3 gene, is assessed by a reduction of the amount of C3 mRNA which can be isolated from or detected in a first cell or group of cells in which a C3 gene is transcribed and which has or have been treated such that the expression of a C3 gene is inhibited, as compared to a second cell or group of cells substantially identical to the first cell or group of cells but which has or have not been so treated (control cells). The degree of inhibition may be expressed in terms of:

$$\frac{(mRNA\text{ in control cells}) - (mRNA\text{ in treated cells})}{(mRNA\text{ in control cells})} \cdot 100\%$$

In one embodiment, inhibition of expression is determined by the dual luciferase method in Example 1 wherein the RNAi agent is present at 10 nM.

The phrase "contacting a cell with an RNAi agent," such as a dsRNA, as used herein, includes contacting a cell by any possible means. Contacting a cell with an RNAi agent includes contacting a cell in vitro with the RNAi agent or contacting a cell in vivo with the RNAi agent. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the central nervous system (CNS), optionally via intrathecal, intravitreal or other injection, or to the bloodstream or the subcutaneous space, such that the agent will subsequently reach the tissue where the cell to be contacted is located. For example, the RNAi agent may contain or be coupled to a ligand, e.g., a lipophilic moiety or moieties as described below and further detailed, e.g., in PCT Publication No. WO 2019/217459, which is incorporated herein by reference, that directs or otherwise stabilizes the RNAi agent at a site of interest, e.g., an ocular cell or a neural cell. In some embodiments, the RNAi agent may contain or be coupled to a ligand, e.g., one or more GalNAc derivatives as described below, that directs or otherwise stabilizes the RNAi agent at a site of interest, e.g., the liver. In other embodiments, the RNAi agent may contain or be coupled to a lipophilic moiety or moieties and one or more GalNAc derivatives. Combinations of in vitro and in vivo methods of contacting are also possible. For example, a cell may also be contacted in vitro with an RNAi agent and subsequently transplanted into a subject.

In one embodiment, contacting a cell with an RNAi agent includes "introducing" or "delivering the RNAi agent into the cell" by facilitating or effecting uptake or absorption into the cell. Absorption or uptake of a RNAi agent can occur through unaided diffusive or active cellular processes, or by auxiliary agents or devices. Introducing a RNAi agent into a cell may be in vitro or in vivo. For example, for in vivo introduction, a RNAi agent can be injected into a tissue site or administered systemically. In vitro introduction into a cell includes methods known in the art such as electroporation and lipofection. Further approaches are described herein below or are known in the art.

As used herein, a "subject" is an animal, such as a mammal, including a primate (such as a human, a non-human primate, e.g., a monkey, and a chimpanzee), or a non-primate (such as a a rat, or a mouse). In one embodiment, the subject is a human, such as a human being treated or assessed for a disease, disorder, or condition that would benefit from reduction in C3 expression; a human at risk for a disease, disorder, or condition that would benefit from reduction in C3 expression; a human having a disease, disorder, or condition that would benefit from reduction in C3 expression; or human being treated for a disease, disorder, or condition that would benefit from reduction in C3 expression as described herein.

As used herein, the terms "treating" or "treatment" refer to a beneficial or desired result including, but not limited to, alleviation or amelioration of one or more signs or symptoms associated with C3 gene expression or C3 protein production, e.g., C3-associated ocular disease or C3-associated neurodegenerative disease, e.g., neuroinflammation, e.g., Alzheimer's disease (AD), Amyotrophic Lateral Sclerosis (ALS), schizophrenia, Parkinson's disease (PD), and prion diseases, such as Creutzfeldt-Jakob disease (CJD), decreased microglial and astrocyte activation and decreased expression or activity C3 in regions of increased neuronal death in subjects having such neurodegenerative diseases. Treatment" can also mean prolonging survival as compared to expected survival in the absence of treatment.

The term "lower" in the context of the level of C3 in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of C3 in a subject may be decreased to a level accepted as within the range of normal for an individual without such disorder. In certain embodiments, "lower" is the decrease in the difference between the level of a marker or symptom for a subject suffering from a disease and a level accepted within the range of normal for an individual, e.g., the level of decrease in bodyweight between an obese individual and an individual having a weight accepted within the range of normal.

As used herein, "prevention" or "preventing," when used in reference to a disease, disorder, or condition thereof, that would benefit from a reduction in expression of a C3 gene or production of a C3 protein, refers to a reduction in the likelihood that a subject will develop a symptom associated with such a disease, disorder, or condition, e.g., a symptom of a C3-associated ocular disease, or C3-associated neurodegenerative disease. The failure to develop a disease, disorder, or condition, or the reduction in the development of a symptom associated with such a disease, disorder, or condition (e.g., by at least about 10% on a clinically accepted scale for that disease or disorder), or the exhibition of delayed symptoms delayed (e.g., by days, weeks, months or years) is considered effective prevention.

A "C3-associated ocular disease" includes any disease associated with the C3 gene or protein in the eye that would benefit from reduction in complement component C3 expression. Such C3-associated ocular diseases are characterized by deposits of byproducts of ocular cell metabolism termed drusen in the macula (AMD and BLD) or neovascularization in the choroid or retina (AMD, DR, DME, RVO) which accumulate and progree leading to obstruction of light transmission, tissue damage, and visual dysfunction or loss.

As used herein a "C3-associated ocular disease" includes, but is not limited to C3-associated age-related macular degeneration (AMD), C3-associated basal laminar drusen (BLD), C3-associated diabetic retinopathy (DR), C3-associated diabetic macular edema (DME), and C3-associated retinal vein occlusion (RVO).

In one embodiment, a complement component C3-associated ocular disease is "age-related macular degeneration" ("AMD"). AMD is the progressive degeneration of the macular, the central part of the retina, in people over 55 years of age. AMD accounts for 8.7% of all blindness worldwide. AMD is characterized by large drusen deposits (deposits containing lipids and proteins) under the retina. There are two types of AMD, referred to as wet AMD and dry AMD.

"Wet AMD," also called "neovascular AMD," is characterized by pathological blood vessel growth from the choroid into the retina (choroidal neovascularization), driven largely by excessive vascular endothelial growth factor (VEGF) production by the retinal pigment epithelium (RPE).

"Dry AMD," also called "geographic atrophy," is caused by RPE cell death and photoreceptor degeneration, leading to vision loss.

In one embodiment, a complement component C3-associated ocular disease is "basal laminal drusen" ("BSD"), also called "cuticular drusen" or "early adult onset, grouped drusen." BSD is a condition in which small drusen randomly deposit in the macula. In late stages, these drusen become more numerous and scatter throughout the retina, which may ultimately lead to a serious pigment epithelial detachment of the macula and result in vision loss. The drusen deposits are often autofluorescent.

In one embodiment, a complement component C3-associated ocular disease is "diabetic retinopathy" ("DR"). DR is a progressive degeneration of retinal vasculature and neurons in subjects having diabetes. After about 20 years of having the disease, nearly all patients with type 1 diabetes will have some DR and more than 50% of type 2 diabetes patients will have DR. In early stages, patients may present with microaneurysm, hard exudates, hemorrhages and cotton-wool spots in the fundus. As the disease progress, new blood vessels may grow due to ischemia but they are fragile, can cause hemorrhage and ultimately destroy the retina.

In one embodiment, a complement component C3-associated ocular disease is "diabetic macular edema" ("DME"). DME is a form of diabetic retinopathy (DR), where the diseased vessels in the retina leak fluid from the circulation into the macula, leading to severe vision loss.

In one embodiment, a complement component C3-associated ocular disease is "retinal vein occlusion" ("RVO"). RVO is a blockage of the small veins that carry blood away from the retina, which is subdivided into central and branch RVO. Central RVO is caused by impaired outflow from the central retinal vein, while branch RVO arises when a branch of the central vein is occluded. Due to the occlusion, the retina is likely to develop ischemia, resulting in increase in VEGF and inflammatory proteins, which may drive the development of macular edema, neovascularization, glaucoma and ultimately blindness if untreated. The occlusion in RVO cannot be treated, but complications can be managed by methods such as focal laser treatment for macular edema or anti-VEGF for neovascularization.

As used herein, the term "C3-associated neurodegenerative disease" or "C3-associated neurodegenerative disorder" is understood as any disease or disorder that would benefit from reduction in the expression or activity of C3. Such C3-neurodegenerative diseases are characterized by neuroinflammation, e.g., increased microglial and astrocyte activation, and increased C3 deposition in areas of the brain associated with neuronal cell death in such diseases (see, e.g., Tenner, et al. (2018) *Mol Immunol* 102:3-13; Bonifati and Kishore (2007) *Mol Immunol* 44:999-1010), e.g., Alzheimer's disease (AD), Amyotrophic Lateral Aclerosis (ALS), schizophrenia, Parkinson's disease (PD), and prion disease, e.g., Creutzfeldt-Jakob disease (CJD).

In one embodiment, a complement component C3-associated neurodegenerative disease is "Alzheimer's disease" ("AD"). AD is a chronic neurodegenerative disease that usually starts slowly and gradually worsens over time. The most common early symptom is difficulty in remembering recent events. As the disease advances, symptoms can include problems with language, disorientation (including easily getting lost), mood swings, loss of motivation, not managing self-care, and behavioral issues. As a person's condition declines, they often withdraw from family and society. Gradually, bodily functions are lost, ultimately leading to death.

Neuropathologically, AD is characterised by loss of neurons and synapses in the cerebral cortex and certain subcortical regions. This loss results in gross atrophy of the affected regions, including degeneration in the temporal lobe and parietal lobe, and parts of the frontal cortex and cingulate gyrus. Degeneration is also present in brainstem nuclei like the locus coeruleus. Studies using MRI and PET have documented reductions in the size of specific brain regions in people with AD as they progressed from mild cognitive impairment to Alzheimer's disease, and in comparison with similar images from healthy older adults.

Both amyloid plaques and neurofibrillary tangles are clearly visible by microscopy in brains of those afflicted by AD. Plaques are dense, mostly insoluble deposits of beta-amyloid peptide and cellular material outside and around neurons. Tangles (neurofibrillary tangles) are aggregates of the microtubule-associated protein tau which has become hyperphosphorylated and accumulate inside the cells themselves. Although many older individuals develop some plaques and tangles as a consequence of ageing, the brains of people with AD have a greater number of them in specific brain regions such as the temporal lobe. Lewy bodies are not rare in the brains of people with AD.

In vitro, it has been shown that fibrillary Aβ activates the classical complement pathway (in the absence of antibody) and the alternative pathway. In addition, in human subjects having AD, C3 has been shown to colocalize with fibrillary amyloid plaques in subjects with cognitive loss and in mouse models of AD (Bradt, B M et al (1998) *J Exp Med* 188(3):431-438). It has also been shown that C3 deficiency prevents neuron loss in two mouse models of AD, the amyloidosis model PS2APP and the tauopathy model TauP301S ((Shi, Q et al (2017) *Sci Transl Med* 9(392): eeaf6295; Wu, T et al (2019) *Cell Rep* 28(8): 2111-2123; Hong, S et al (2016) *Science* 352(6286): 712-716).

In one embodiment, a complement component C3-associated neurodegenerative disease is "Amyotrphic Lateral Sclerosis" ("ALS").

Amyotrophic lateral sclerosis (ALS) is a progressive disease that affects motor neurons in the spinal cord and the brain. In ALS, motor neurons die (atrophy) over time, leading to muscle weakness, a loss of muscle mass, and an inability to control movement.

People with sporadic ALS usually first develop features of the condition in their late fifties or early sixties.

The earliest symptoms of ALS include muscle twitching, cramping, stiffness, or weakness. Affected individuals may develop slurred speech (dysarthria) and, later, difficulty chewing or swallowing (dysphagia). Many people with ALS experience malnutrition because of reduced food intake due to dysphagia and an increase in their body's energy demands (metabolism) due to prolonged illness. Muscles become weaker as the disease progresses, and arms and legs begin to look thinner as muscle tissue atrophies. Individuals with ALS eventually lose muscle strength and the ability to walk. Affected individuals eventually become wheelchair-dependent and increasingly require help with personal care and other activities of daily living. Over time, muscle weakness causes affected individuals to lose the use of their hands and arms. Breathing becomes difficult because the muscles of the respiratory system weaken. Most people with ALS die from respiratory failure within 2 to 10 years after the signs and symptoms of ALS first appear; however, disease progression varies widely among affected individuals.

Increase C3 and C4 activation products have been found in post-mortem motor cortex and spinal cord tissue in ALS sufferers and complement activation fragments are present in the CSF and plasma of living ALS subjects. Furthermore, SOD1 transgenic mice, an art-recognized model of ALS have markedly elevated CNS and muscle expression of complement genes, including C3, early in the disease process. These mice also have elevated microglial and astrocyte activation in regions of motor neuron death in the CNS.

In one embodiment, a complement component C3-associated neurodegenerative disease is "Parkinson's disease" ("PD").

Parkinson disease is a progressive disorder of the nervous system. The disorder affects several regions of the brain, especially an area called the substantia nigra that controls balance and movement. PD leads to loss of dopaminergic neurons within the basal ganglia.

Often the first symptom of Parkinson disease is trembling or shaking (tremor) of a limb, especially when the body is at rest. Typically, the tremor begins on one side of the body, usually in one hand. Tremors can also affect the arms, legs, feet, and face. Other characteristic symptoms of Parkinson disease include rigidity or stiffness of the limbs and torso, slow movement (bradykinesia) or an inability to move (akinesia), and impaired balance and coordination (postural instability). These symptoms worsen slowly over time.

Parkinson disease can also affect emotions and thinking ability (cognition). Some affected individuals develop psychiatric conditions such as depression and visual hallucinations. People with Parkinson disease also have an increased risk of developing dementia, which is a decline in intellectual functions including judgment and memory.

Deposition of C3 in Lewy bodies and melanized neurons increased has been shown to be elevated in the brains of PD patients compared to age-matched controls (Loeffler, D A et al (2006) *J Neuroinflammation* 3:29). Furthermore, mice carrying a knockout of the iC3b receptor were protected from dopaminergic neuron loss and motor dysfunction, demonstrating that the complement system and C3 take part in the disease progress (Hou, L et al (2018) *Redox Biol* 14: 250-260).

In one embodiment, a complement component C3-associated neurodegenerative disease is "schizophrenia."

Schizophrenia is a neurodegenerative disorder classified as a psychosis, that typically becomes evident during late adolescence or early adulthood.

Signs and symptoms of schizophrenia include false perceptions called hallucinations. Auditory hallucinations of voices are the most common hallucinations in schizophrenia, but affected individuals can also experience hallucinations of visions, smells, or touch (tactile) sensations. Strongly held false beliefs (delusions) are also characteristic of schizophrenia.

People with schizophrenia may have diminished facial expression and animation (flat affect), and in some cases become unresponsive (catatonic). Substance abuse and suicidal thoughts and actions are common in people with schizophrenia.

Certain movement problems such as tremors, facial tics, rigidity, and unusually slow movement (bradykinesia) or an inability to move (akinesia) are common in people with schizophrenia. In most cases these are side effects of medicines prescribed to help control the disorder. However, some affected individuals exhibit movement abnormalities before beginning treatment with medication.

Schizphrenia has been associated with alleles of complement component C4, a protein that increases classical component activation and C3 deposition. C4 protein mediates developmental synapse-pruning but excessive pruning can lead to defects in synaptic connectivity that can contribute to long-term deficits in cognition and behavior, such as the defects observed in schizophrenia. Additionally, neuroanatomical and neuroimaging studies have demonstrated corticol thining and loss of dendritic spines in subjects having schizophrenia In one embodiment, a complement component C3-associated neurodegenerative disease is "prion disease", such as "Creutzfeldt-Jakob disease" ("CJD").

CJD belongs to a family of human and animal diseases known as the transmissible spongiform encephalopathies (TSEs) or prion diseases. A prion—derived from "protein" and "infectious"—causes CJD in people and TSEs in animals. Spongiform refers to the characteristic appearance of infected brains, which become filled with holes until they resemble sponges when examined under a microscope. CJD is the most common of the known human TSEs. Other human TSEs include kuru, fatal familial insomnia (FFI), and Gerstmann-Straussler-Scheinker disease (GSS). Kuru was identified in people of an isolated tribe who practiced ritual cannibalisms in Papua, New Guinea and has now almost disappeared. Kuru is considered an acquired prion disease. FFI and GSS are extremely rare hereditary diseases, found in just a few families around the world.

Creutzfeldt-Jakob disease (CJD) is a rare, degenerative, fatal brain disorder. It affects about one person in every one million per year worldwide; in the U.S. there are about 350 cases per year. CJD usually appears in later life and runs a rapid course. Typical onset of symptoms occurs at about age 60, and about 70 percent of individuals die within one year. In the early stages of the disease, people may have failing memory, behavioral changes, lack of coordination, and visual disturbances. As the illness progresses, mental deterioration becomes pronounced and involuntary movements, blindness, weakness of extremities, and coma may occur.

There are three major categories of CJD.

In sporadic CJD, the disease appears even though the person has no known risk factors for the disease. This is by far the most common type of CJD and accounts for at least 85 percent of cases.

In hereditary CJD, the person may have a family history of the disease and test positive for a genetic mutation associated with CJD. About 10 to 15 percent of cases of CJD in the U.S. are hereditary.

In acquired CJD, the disease is transmitted by exposure to brain or nervous system tissue, usually through certain medical procedures. There is no evidence that CJD is contagious through casual contact with someone who has CJD. Since CJD was first described in 1920, fewer than one percent of cases have been acquired CJD. A type of CJD called variant CJD (or vCJD) can be acquired by eating meat from cattle affected by a disease similar to CJD called bovine spongiform encephalopathy (BSE) or, commonly, "mad cow" disease.

CJD is characterized by rapidly progressive dementia. Initially, individuals experience problems with muscle coordination, personality changes (including impaired memory, judgment, and thinking), and impaired vision. People with the disease, especially with FFI, also may experience insomnia, depression, or unusual sensations. As the illness progresses, peoples' mental impairment becomes severe. They often develop involuntary muscle jerks called myoclonus, and they may go blind. They eventually lose the ability to move and speak, and enter a coma. Pneumonia and other infections often occur in these individuals and can lead to death.

Variant CJD begins primarily with psychiatric symptoms, affects younger individuals than other types of CJD, and has a longer than usual duration from onset of symptoms to death.

Some symptoms of CJD can be similar to symptoms of other progressive neurological disorders, such as Alzheimer's and Huntington's disease. However, CJD causes unique changes in brain tissue which can be seen at autopsy. It also tends to cause more rapid deterioration of a person's abilities than Alzheimer's disease or most other types of dementia.

The prion plaques in the brains of human subjects having CJD immunolabel with complement proteins which also show recruitment and activation of microglia and the presence of active C3. Temporary depletion of C3 by cobra venom factor also significantly delayed onset of the disease following peripheral infection and reduced the early accumulation of the scrapie isoform of PrP in the spleen (Mabbot, N et al (2001) *Nat Med* 7: 485-487).

"Therapeutically effective amount," as used herein, is intended to include the amount of an RNAi agent that, when administered to a subject having a C3-associated neurodegenerative disease or C3-associated ocular disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of a RNAi agent that, when administered to a subject having a C3-associated neurodegenerative disorder or C3-associated ocular disease, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of a RNAi agent that produces some desired local or systemic effect at a reasonable benefit/risk ratio applicable to any treatment. A RNAi agent employed in the methods of the present disclosure may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the brain (e.g., whole brain or certain segments of brain, e.g., striatum, or certain types of cells in the brain, such as, e.g., neurons and glial cells (astrocytes, oligodendrocytes, microglial cells)). In other embodiments, a "sample derived from a subject" refers to liver tissue (or subcomponents thereof) derived from the subject. In some embodiments, a "sample derived from a subject" refers to blood drawn from the subject or plasma or serum derived therefrom. In further embodiments, a "sample derived from a subject" refers to brain tissue (or subcomponents thereof) or retinal tissue (or subcomponents thereof) derived from the subject. In certain embodiments, samples may be derived from the retina or parts of the retina (e.g., retinal pigment epithelium and/or ciliary epithelium). In some embodiments, a "sample derived from a subject" refers to retinal tissue derived from the subject.

II. LIPOPHILIC MOIETIES

The present invention provides dsRNA agents comprising a sense strand and an antisense strand forming a double stranded region targeting a portion of a complement component C3 gene, wherein one or more lipophilic moieties are conjugated to one or more internal positions on at least one strand, or one or more positions on at least one strand within the double stranded region of a double-stranded iRNA, optionally via a linker or carrier. The dsRNA agents of the invention comprising one or more lipophilic moieties conjugated to one or more internal nucleotides of at least one strand, or one or more positions on at least one strand within the double stranded region of a double-stranded iRNA, have optimal hydrophobicity for the enhanced in vivo delivery of the dsRNAs to an ocular cell or a neural cell.

The term "lipophile" or "lipophilic moiety" broadly refers to any compound or chemical moiety having an affinity for lipids. One way to characterize the lipophilicity of the lipophilic moiety is by the octanol-water partition coefficient, log $K_{ow}$, where $K_{ow}$ is the ratio of a chemical's concentration in the octanol-phase to its concentration in the aqueous phase of a two-phase system at equilibrium. The octanol-water partition coefficient is a laboratory-measured property of a substance. However, it may also be predicted by using coefficients attributed to the structural components of a chemical which are calculated using first-principle or empirical methods (see, for example, Tetko et al., *J. Chem. Inf Comput. Sci.* 41:1407-21 (2001), the entire contents of which is incorporated herein by reference). It provides a thermodynamic measure of the tendency of the substance to prefer a non-aqueous or oily milieu rather than water (i.e. its hydrophilic/lipophilic balance). In principle, a chemical substance is lipophilic in character when its log $K_{ow}$ exceeds 0. Typically, the lipophilic moiety possesses a log $K_{ow}$ exceeding 1, exceeding 1.5, exceeding 2, exceeding 3, exceeding 4, exceeding 5, or exceeding 10. For instance, the log $K_{ow}$ of 6-amino hexanol, for instance, is predicted to be approximately 0.7. Using the same method, the log $K_{ow}$ of cholesteryl N-(hexan-6-ol) carbamate is predicted to be 10.7.

The lipophilicity of a molecule can change with respect to the functional group it carries. For instance, adding a hydroxyl group or amine group to the end of a lipophilic moiety can increase or decrease the partition coefficient (e.g., log $K_{ow}$) value of the lipophilic moiety.

Alternatively, the hydrophobicity of the double-stranded iRNA agent, conjugated to one or more lipophilic moieties, can be measured by its protein binding characteristics. For instance, the unbound fraction in the plasma protein binding assay of the double-stranded iRNA agent can be determined to positively correlate to the relative hydrophobicity of the double-stranded iRNA agent, which can positively correlate to the silencing activity of the double-stranded iRNA agent.

In one embodiment, the plasma protein binding assay determined is an electrophoretic mobility shift assay (EMSA) using human serum albumin protein. The hydrophobicity of the double-stranded iRNA agent, measured by fraction of unbound siRNA in the binding assay, exceeds 0.15, exceeds 0.2, exceeds 0.25, exceeds 0.3, exceeds 0.35, exceeds 0.4, exceeds 0.45, or exceeds 0.5 for an enhanced in vivo delivery of siRNA.

Accordingly, conjugating the lipophilic moieties to the internal position(s) of the double-stranded iRNA agent, or position(s) within the double stranded portion of the RNAi agent, provides optimal hydrophobicity for the enhanced in vivo ocular or neural delivery of siRNA.

In certain embodiments, the lipophilic moiety is an aliphatic, cyclic such as alicyclic, or polycyclic such as polyalicyclic compound, such as a steroid (e.g., sterol) or a linear or branched aliphatic hydrocarbon. The lipophilic moiety may generally comprise a hydrocarbon chain, which may be cyclic or acyclic. The hydrocarbon chain may comprise various substituents or one or more heteroatoms, such as an oxygen or nitrogen atom. Such lipophilic aliphatic moieties include, without limitation, saturated or unsaturated $C_4$-$C_{30}$ hydrocarbon (e.g., $C_6$-$C_{18}$ hydrocarbon), saturated or unsaturated fatty acids, waxes (e.g., monohydric alcohol esters of fatty acids and fatty diamides), terpenes (e.g., $C_{10}$ terpenes, $C_{15}$ sesquiterpenes, $C_{20}$ diterpenes, $C_{30}$ triterpenes, and $C_{40}$ tetraterpenes), and other polyalicyclic hydrocarbons. For instance, the lipophilic moiety may contain a $C_4$-$C_{30}$ hydrocarbon chain (e.g., $C_4$-$C_{30}$ alkyl or alkenyl). In some embodiment the lipophilic moiety contains a saturated or unsaturated $C_6$-$C_{18}$ hydrocarbon chain (e.g., a linear $C_6$-$C_{18}$ alkyl or alkenyl). In one embodiment, the lipophilic moiety contains a saturated or unsaturated $C_{16}$ hydrocarbon chain (e.g., a linear $C_{16}$ alkyl or alkenyl).

The lipophilic moiety may be attached to the iRNA agent by any method known in the art, including via a functional grouping already present in the lipophilic moiety or introduced into the iRNA agent, such as a hydroxy group (e.g., $—CO—CH_2—OH$). The functional groups already present in the lipophilic moiety or introduced into the iRNA agent include, but are not limited to, hydroxyl, amine, carboxylic acid, sulfonate, phosphate, thiol, azide, and alkyne.

Conjugation of the iRNA agent and the lipophilic moiety may occur, for example, through formation of an ether or a carboxylic or carbamoyl ester linkage between the hydroxy and an alkyl group R—, an alkanoyl group RCO— or a substituted carbamoyl group RNHCO—. The alkyl group R may be cyclic (e.g., cyclohexyl) or acyclic (e.g., straight-chained or branched; and saturated or unsaturated). Alkyl group R may be a butyl, pentyl, hexyl, heptyl, octyl, nonyl, decyl, undecyl, dodecyl, tridecyl, tetradecyl, pentadecyl, hexadecyl, heptadecyl or octadecyl group, or the like.

In some embodiments, the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

In another embodiment, the lipophilic moiety is a steroid, such as sterol. Steroids are polycyclic compounds containing a perhydro-1,2-cyclopentanophenanthrene ring system. Steroids include, without limitation, bile acids (e.g., cholic acid, deoxycholic acid and dehydrocholic acid), cortisone, digoxigenin, testosterone, cholesterol, and cationic steroids, such as cortisone. A "cholesterol derivative" refers to a compound derived from cholesterol, for example by substitution, addition or removal of substituents.

In another embodiment, the lipophilic moiety is an aromatic moiety. In this context, the term "aromatic" refers broadly to mono- and polyaromatic hydrocarbons. Aromatic groups include, without limitation, $C_6$-$C_{14}$ aryl moieties comprising one to three aromatic rings, which may be optionally substituted; "aralkyl" or "arylalkyl" groups comprising an aryl group covalently linked to an alkyl group, either of which may independently be optionally substituted or unsubstituted; and "heteroaryl" groups. As used herein, the term "heteroaryl" refers to groups having 5 to 14 ring atoms, or 5, 6, 9, or 10 ring atoms; having 6, 10, or 1471 electrons shared in a cyclic array, and having, in addition to carbon atoms, between one and about three heteroatoms selected from the group consisting of nitrogen (N), oxygen (O), and sulfur (S).

As employed herein, a "substituted" alkyl, cycloalkyl, aryl, heteroaryl, or heterocyclic group is one having between one and about four, or between one and about three, or one or two, non-hydrogen substituents. Suitable substituents include, without limitation, halo, hydroxy, nitro, haloalkyl, alkyl, alkaryl, aryl, aralkyl, alkoxy, aryloxy, amino, acylamino, alkylcarbamoyl, arylcarbamoyl, aminoalkyl, alkoxycarbonyl, carboxy, hydroxyalkyl, alkanesulfonyl, arenesulfonyl, alkanesulfonamido, arenesulfonamido, aralkylsulfonamido, alkylcarbonyl, acyloxy, cyano, and ureido groups.

In some embodiments, the lipophilic moiety is an aralkyl group, e.g., a 2-arylpropanoyl moiety. The structural features of the aralkyl group are selected so that the lipophilic moiety will bind to at least one protein in vivo. In certain embodiments, the structural features of the aralkyl group are selected so that the lipophilic moiety binds to serum, vascular, or cellular proteins. In certain embodiments, the structural features of the aralkyl group promote binding to albumin, an immunoglobulin, a lipoprotein, α-2-macroglubulin, or α-1-glycoprotein.

In certain embodiments, the ligand is naproxen or a structural derivative of naproxen. Procedures for the synthesis of naproxen can be found in U.S. Pat. Nos. 3,904,682 and 4,009,197, which are hereby incorporated by reference in their entirety. Naproxen has the chemical name (S)-6-Methoxy-α-methyl-2-naphthaleneacetic acid and the structure is

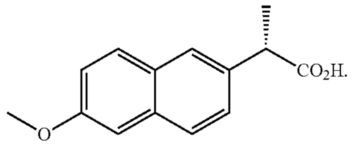 [SMILES: COc1ccc2cc([C@H](C)C(=O)O)ccc2c1]

In certain embodiments, the ligand is ibuprofen or a structural derivative of ibuprofen. Procedures for the synthesis of ibuprofen can be found in U.S. Pat. No. 3,228,831, which are hereby incorporated by reference in their entirety. The structure of ibuprofen is

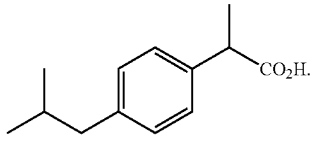

Additional exemplary aralkyl groups are illustrated in U.S. Pat. No. 7,626,014, which is incorporated herein by reference in its entirety.

In another embodiment, suitable lipophilic moieties include lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, ibuprofen, naproxen, dimethoxytrityl, or phenoxazine.

In certain embodiments, more than one lipophilic moieties can be incorporated into the double-strand iRNA agent, particularly when the lipophilic moiety has a low lipophilicity or hydrophobicity. In one embodiment, two or more lipophilic moieties are incorporated into the same strand of the double-strand iRNA agent. In one embodiment, each strand of the double-strand iRNA agent has one or more lipophilic moieties incorporated. In one embodiment, two or more lipophilic moieties are incorporated into the same position (i.e., the same nucleobase, same sugar moiety, or same internucleosidic linkage) of the double-strand iRNA agent. This can be achieved by, e.g., conjugating the two or more lipophilic moieties via a carrier, or conjugating the two or more lipophilic moieties via a branched linker, or conjugating the two or more lipophilic moieties via one or more linkers, with one or more linkers linking the lipophilic moieties consecutively.

The lipophilic moiety may be conjugated to the iRNA agent via a direct attachment to the ribosugar of the iRNA agent. Alternatively, the lipophilic moiety may be conjugated to the double-strand iRNA agent via a linker or a carrier.

In certain embodiments, the lipophilic moiety may be conjugated to the iRNA agent via one or more linkers (tethers).

In one embodiment, the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

A. Linkers/Tethers

Linkers/Tethers are connected to the lipophilic moiety at a "tethering attachment point (TAP)." Linkers/Tethers may include any $C_1$-$C_{100}$ carbon-containing moiety, (e.g. $C_1$-$C_{75}$, $C_1$-$C_{50}$, $C_1$-$C_{20}$, $C_1$-$C_{10}$; $C_1$, $C_2$, $C_3$, $C_4$, $C_5$, $C_6$, $C_7$, $C_8$, $C_9$, or $C_{10}$), and may have at least one nitrogen atom. In certain embodiments, the nitrogen atom forms part of a terminal amino or amido (NHC(O)—) group on the linker/tether, which may serve as a connection point for the lipophilic moiety. Non-limited examples of linkers/tethers (underlined) include TAP-$(CH_2)_n$NH—; TAP-C(O)$(CH_2)_n$NH—; TAP-NR""$(CH_2)_n$NH—, TAP-C(O)—$(CH_2)_n$—C(O)—; TAP-C(O)—$(CH_2)_n$—C(O)O—; TAP-C(O)—O—; TAP-C(O)—$(CH_2)_n$—NH—C(O)—; TAP-C(O)—$(CH_2)_n$—; TAP-C(O)—NH—; TAP-C(O)—; TAP-$(CH_2)_n$—C(O)—; TAP-$(CH_2)_n$—C(O)O—; TAP-$(CH_2)_n$—; or TAP-$(CH_2)_n$—NH—C(O)—; in which n is 1-20 (e.g., 1, 2, 3, 4, 5, 6, 7, 8, 9, 10, 11, 12, 13, 14, 15, 16, 17, 18, 19, or 20) and R"" is $C_1$-$C_6$ alkyl. In some embodiments, n is 5, 6, or 11. In other embodiments, the nitrogen may form part of a terminal oxyamino group, e.g., —$ONH_2$, or hydrazino group, —$NHNH_2$. The linker/tether may optionally be substituted, e.g., with hydroxy, alkoxy, perhaloalkyl, or optionally inserted with one or more additional heteroatoms, e.g., N, O, or S. In some embodiments, tethered ligands may include, e.g., TAP-$(CH_2)_n$NH(LIGAND); TAP-C(O)$(CH_2)_n$NH(LIGAND); TAP-NR""$(CH_2)_n$NH(LIGAND); TAP-$(CH_2)_n$ONH(LIGAND); TAP-C(O)$(CH_2)_n$ONH(LIGAND); TAP-NR""$(CH_2)_n$ONH(LIGAND); TAP-$(CH_2)_n$NHNH$_2$(LIGAND), TAP-C(O)$(CH_2)_n$NHNH$_2$(LIGAND); TAP-NR""$(CH_2)_n$NHNH$_2$(LIGAND); TAP-C(O)—$(CH_2)_n$—C(O)(LIGAND); TAP-C(O)—$(CH_2)_n$—C(O)O(LIGAND); TAP-C(O)—O(LIGAND); TAP-C(O)—$(CH_2)_n$—NH—C(O)(LIGAND); TAP-C(O)—$(CH_2)_n$(LIGAND); TAP-C(O)—NH(LIGAND); TAP-C(O)(LIGAND); TAP-$(CH_2)_n$—C(O)(LIGAND); TAP-$(CH_2)_n$—C(O)O(LIGAND); TAP-$(CH_2)_n$(LIGAND); or TAP-$(CH_2)_n$—NH—C(O)(LIGAND). In some embodiments, amino terminated linkers/tethers (e.g., $NH_2$, $ONH_2$, $NH_2NH_2$) can form an imino bond (i.e., C═N) with the ligand. In some embodiments, amino terminated linkers/tethers (e.g., $NH_2$, $ONH_2$, $NH_2NH_2$) can acylated, e.g., with C(O)$CF_3$.

In some embodiments, the linker/tether can terminate with a mercapto group (i.e., SH) or an olefin (e.g., CH═$CH_2$). For example, the tether can be TAP-$(CH_2)_n$—SH, TAP-C(O)$(CH_2)_n$SH, TAP-$(CH_2)_n$—(CH═$CH_2$), or TAP-C(O)$(CH_2)_n$(CH═$CH_2$), in which n can be as described elsewhere. The tether may optionally be substituted, e.g., with hydroxy, alkoxy, perhaloalkyl, or optionally inserted with one or more additional heteroatoms, e.g., N, O, or S. The double bond can be cis or trans or E or Z.

In other embodiments, the linker/tether may include an electrophilic moiety, or at the terminal position of the linker/tether. Exemplary electrophilic moieties include, e.g., an aldehyde, alkyl halide, mesylate, tosylate, nosylate, or brosylate, or an activated carboxylic acid ester, e.g. an NHS ester, or a pentafluorophenyl ester. In some embodiments, linkers/tethers (underlined) include TAP-$(CH_2)_n$CHO; TAP-C(O)$(CH_2)_n$CHO; or TAP-NR""$(CH_2)_n$CHO, in which n is 1-6 and R"" is $C_1$-$C_6$ alkyl; or TAP-$(CH_2)_n$C(O)ONHS; TAP-C(O)$(CH_2)_n$C(O)ONHS; or TAP-NR""$(CH_2)_n$C(O)ONHS, in which n is 1-6 and R"" is $C_1$-$C_6$ alkyl; TAP-$(CH_2)_n$C(O)O$C_6F_5$; TAP-C(O)$(CH_2)_n$C(O) O$C_6F_5$; or TAP-NR""$(CH_2)_n$C(O) O$C_6F_5$, in which n is 1-11 and R"" is $C_1$-$C_6$ alkyl; or —$(CH_2)_n$$CH_2$LG; TAP-C(O)$(CH_2)_n$$CH_2$LG; or TAP-NR""$(CH_2)_n$$CH_2$LG, in which n can be as described elsewhere and R"" is $C_1$-$C_6$ alkyl (LG can be a leaving group, e.g., halide, mesylate, tosylate, nosylate, brosylate). Tethering can be carried out by coupling a nucleophilic group of a ligand, e.g., a thiol or amino group with an electrophilic group on the tether.

In other embodiments, it can be desirable for the monomer to include a phthalimido group (K) at the terminal position of the linker/tether.

K

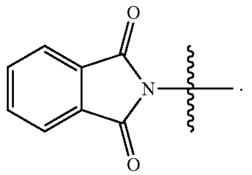

In other embodiments, other protected amino groups can be at the terminal position of the linker/tether, e.g., alloc, monomethoxy trityl (MMT), trifluoroacetyl, Fmoc, or aryl sulfonyl (e.g., the aryl portion can be ortho-nitrophenyl or ortho, para-dinitrophenyl).

Any of the linkers/tethers described herein may further include one or more additional linking groups, e.g., $—O—(CH_2)_n—$, $—(CH_2)_n—SS—$, $—(CH_2)_n—$, or $—(CH═CH)—$.

B. Cleavable Linkers/Tethers

In some embodiments, at least one of the linkers/tethers can be a redox cleavable linker, an acid cleavable linker, an esterase cleavable linker, a phosphatase cleavable linker, or a peptidase cleavable linker.

In one embodiment, at least one of the linkers/tethers can be a reductively cleavable linker (e.g., a disulfide group).

In one embodiment, at least one of the linkers/tethers can be an acid cleavable linker (e.g., a hydrazone group, an ester group, an acetal group, or a ketal group).

In one embodiment, at least one of the linkers/tethers can be an esterase cleavable linker (e.g., an ester group).

In one embodiment, at least one of the linkers/tethers can be a phosphatase cleavable linker (e.g., a phosphate group).

In one embodiment, at least one of the linkers/tethers can be a peptidase cleavable linker (e.g., a peptide bond).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some tethers will have a linkage group that is cleaved at a preferred pH, thereby releasing the iRNA agent from a ligand (e.g., a targeting or cell-permeable ligand, such as cholesterol) inside the cell, or into the desired compartment of the cell.

A chemical junction (e.g., a linking group) that links a ligand to an iRNA agent can include a disulfide bond. When the iRNA agent/ligand complex is taken up into the cell by endocytosis, the acidic environment of the endosome will cause the disulfide bond to be cleaved, thereby releasing the iRNA agent from the ligand (Quintana et al., *Pharm Res.* 19:1310-1316, 2002; Patri et al., *Curr. Opin. Curr. Biol.* 6:466-471, 2002). The ligand can be a targeting ligand or a second therapeutic agent that may complement the therapeutic effects of the iRNA agent.

A tether can include a linking group that is cleavable by a particular enzyme. The type of linking group incorporated into a tether can depend on the cell to be targeted by the iRNA agent. For example, an iRNA agent that targets an mRNA in liver cells can be conjugated to a tether that includes an ester group. Liver cells are rich in esterases, and therefore the tether will be cleaved more efficiently in liver cells than in cell types that are not esterase-rich. Cleavage of the tether releases the iRNA agent from a ligand that is attached to the distal end of the tether, thereby potentially enhancing silencing activity of the iRNA agent. Other cell-types rich in esterases include cells of the lung, renal cortex, and testis.

Tethers that contain peptide bonds can be conjugated to iRNA agents target to cell types rich in peptidases, such as liver cells and synoviocytes. For example, an iRNA agent targeted to synoviocytes, such as for the treatment of an inflammatory disease (e.g., rheumatoid arthritis), can be conjugated to a tether containing a peptide bond.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue, e.g., tissue the iRNA agent would be exposed to when administered to a subject. Thus one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. In preferred embodiments, useful candidate compounds are cleaved at least 2, 4, 10 or 100 times faster in the cell (or under in vitro conditions selected to mimic intracellular conditions) as compared to blood or serum (or under in vitro conditions selected to mimic extracellular conditions).

i. Redox Cleavable Linking Groups

One class of cleavable linking groups are redox cleavable linking groups that are cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In a preferred embodiment, candidate compounds are cleaved by at most 10% in the blood. In preferred embodiments, useful candidate compounds are degraded at least 2, 4, 10 or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

Phosphate-based linking groups are cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

Acid cleavable linking groups are linking groups that are cleaved under acidic conditions. In preferred embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, ketals, acetals, esters, and esters of amino acids. Acid cleavable groups can have the general formula —C═NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

Ester-based linking groups are cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

Peptide-based linking groups are cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide cleavable linking groups have the general formula —NHCHR$^1$C(O)NHCHR$^2$C(O)—, where R$^1$ and R$^2$ are the R groups of the two adjacent amino acids. These candidates can be evaluated using methods analogous to those described above.

vi. Biocleavable Linkers/Tethers

The linkers can also include biocleavable linkers that are nucleotide and non-nucleotide linkers or combinations thereof that connect two parts of a molecule, for example, one or both strands of two individual siRNA molecule to generate a bis(siRNA). In some embodiments, mere electrostatic or stacking interaction between two individual siRNAs can represent a linker. The non-nucleotide linkers include tethers or linkers derived from monosaccharides, disaccharides, oligosaccharides, and derivatives thereof, aliphatic, alicyclic, hetercyclic, and combinations thereof.

In some embodiments, at least one of the linkers (tethers) is a bio-cleavable linker selected from the group consisting of DNA, RNA, disulfide, amide, functionalized monosaccharides or oligosaccharides of galactosamine, glucosamine, glucose, galactose, and mannose, and combinations thereof.

In one embodiment, the bio-cleavable carbohydrate linker may have 1 to 10 saccharide units, which have at least one anomeric linkage capable of connecting two siRNA units. When two or more saccharides are present, these units can be linked via 1-3, 1-4, or 1-6 sugar linkages, or via alkyl chains.

Exemplary bio-cleavable linkers include:

Q198

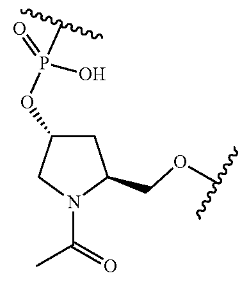

Q303

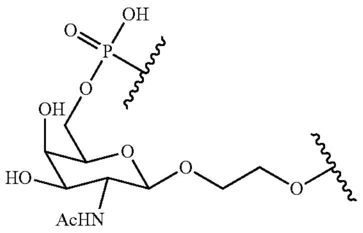

Q48

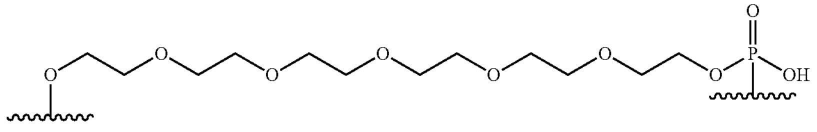

-continued
Q304
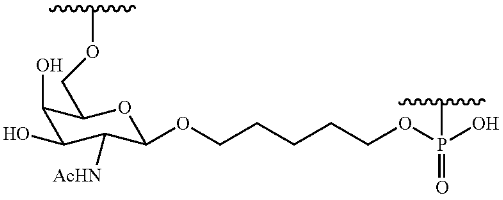
Q305
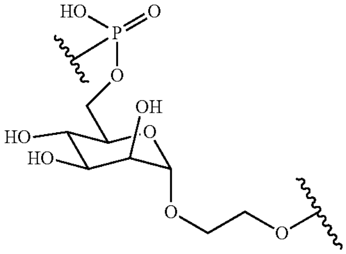
Q306
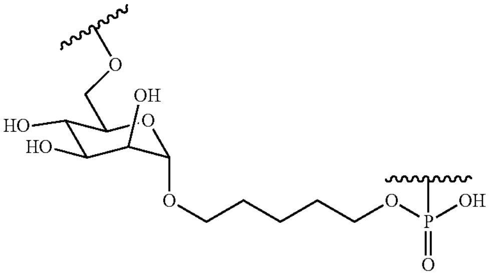
Q312
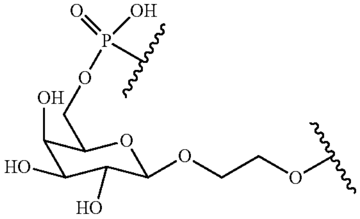
Q313
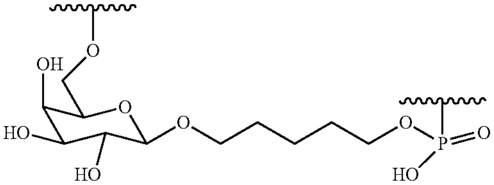
Q314
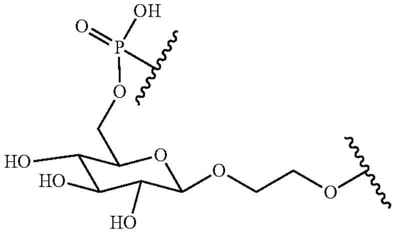
Q315
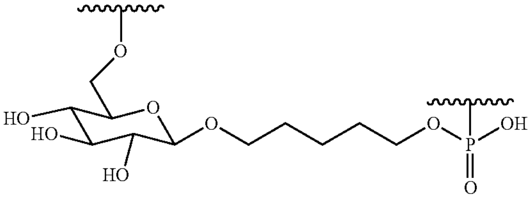
Q316
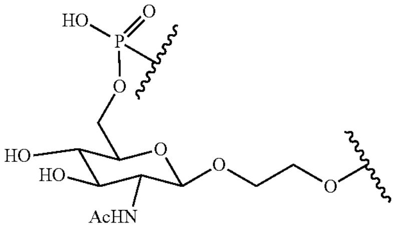
Q317
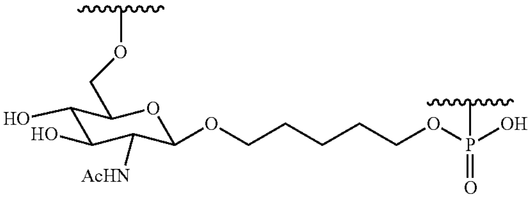
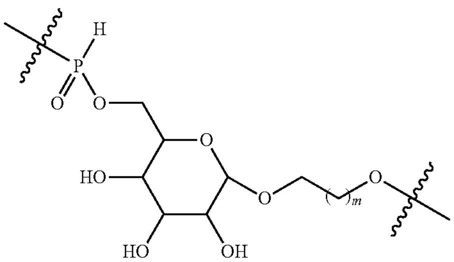
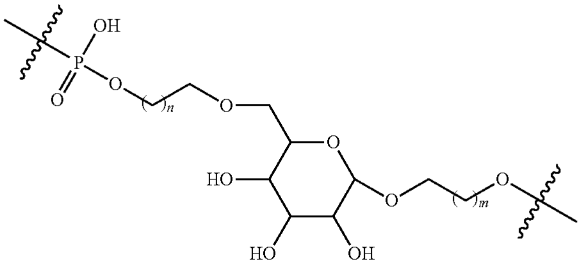

-continued
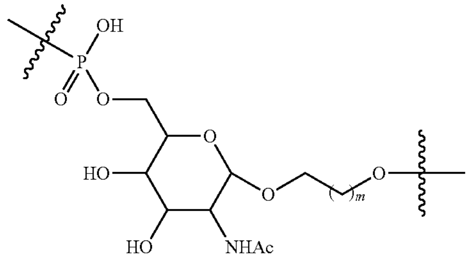
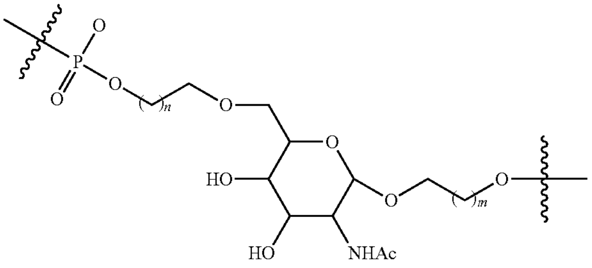
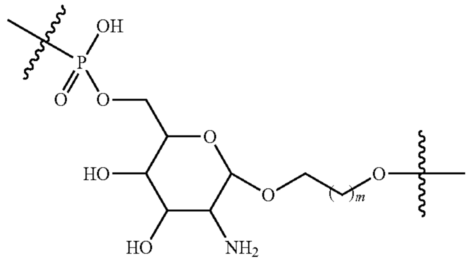
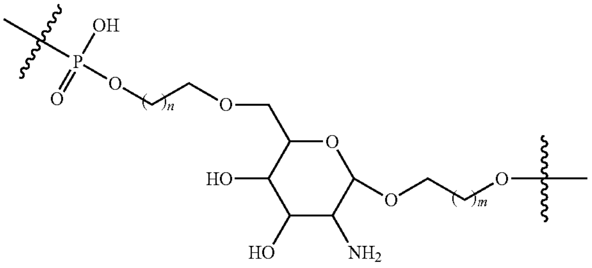
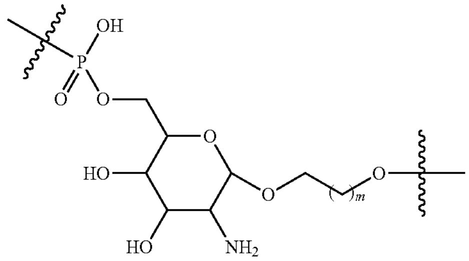
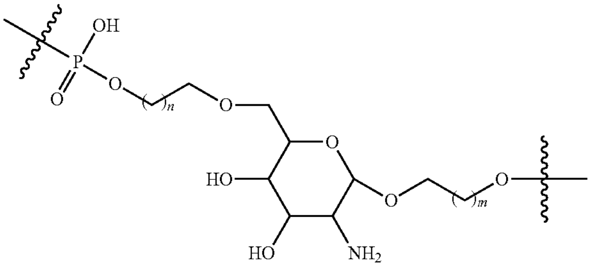
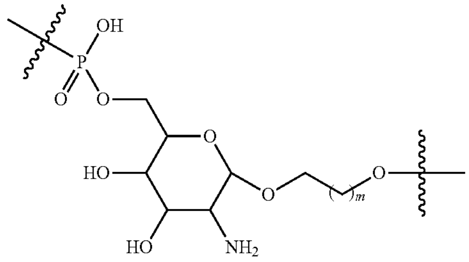
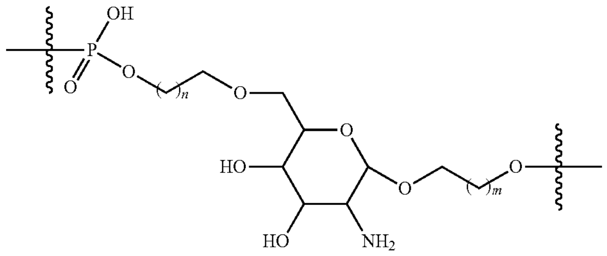
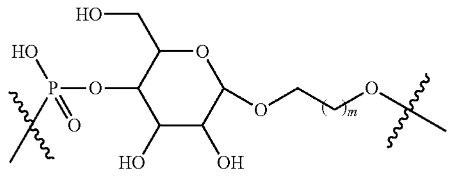
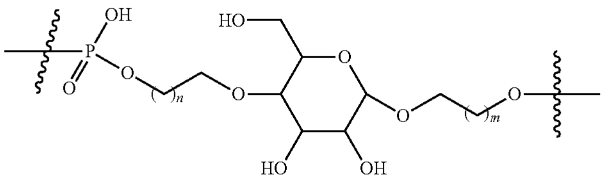
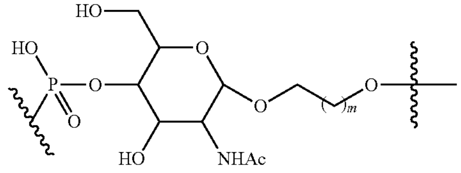
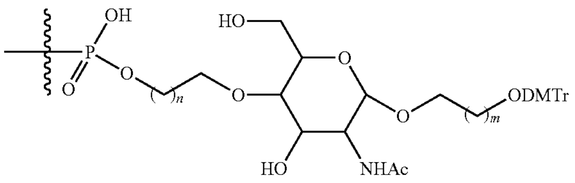
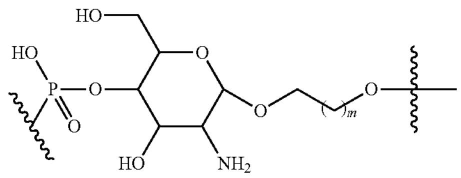
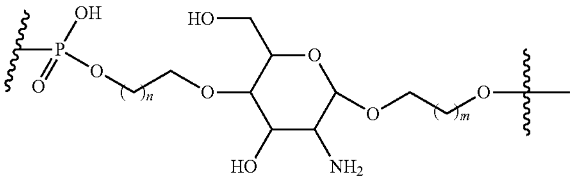

-continued
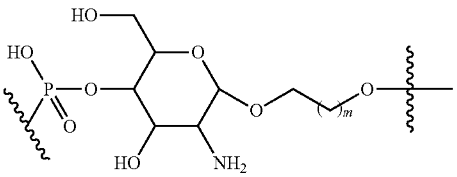
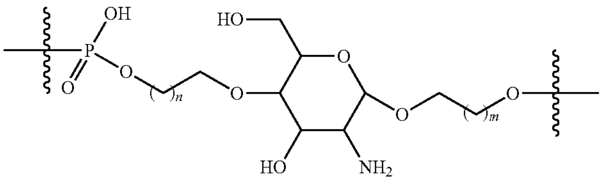
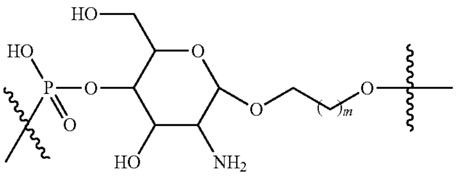
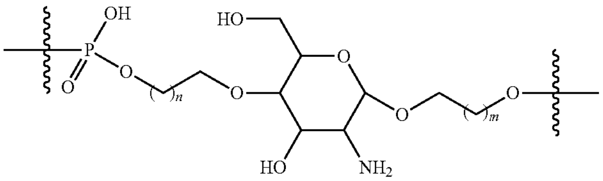
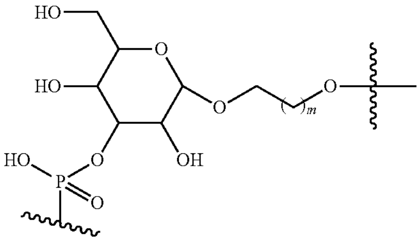
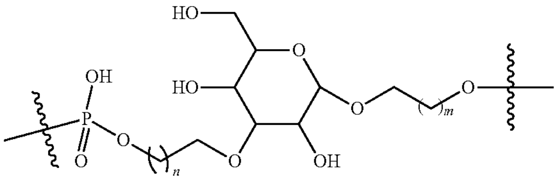
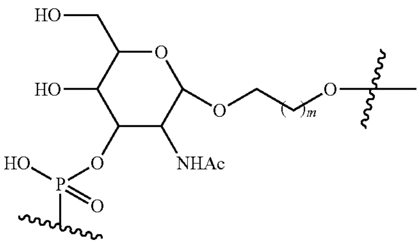
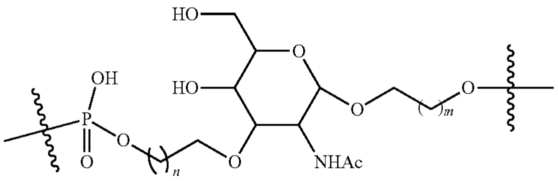
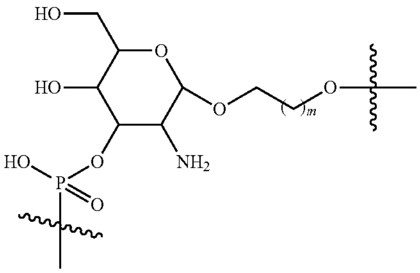
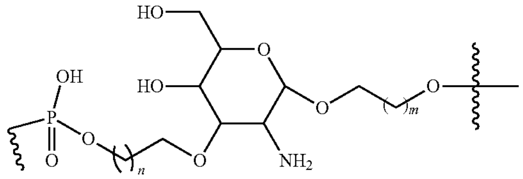
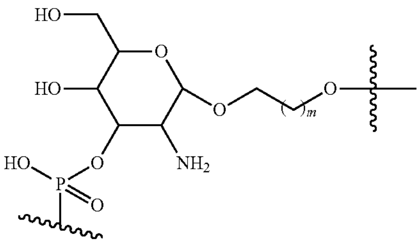
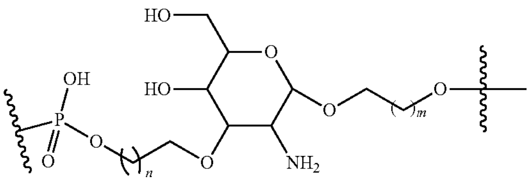
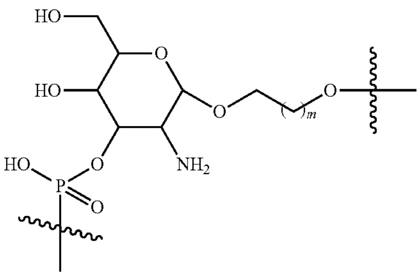
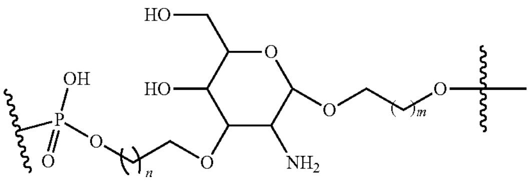

-continued
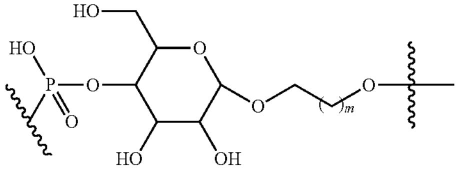
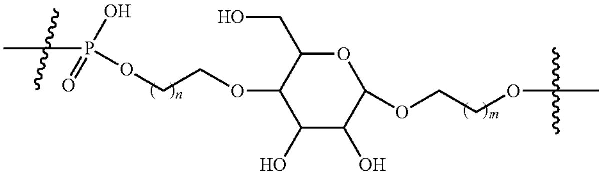
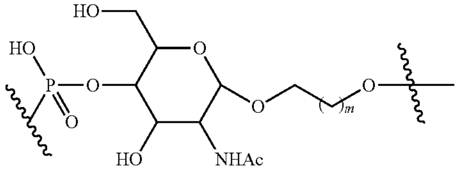
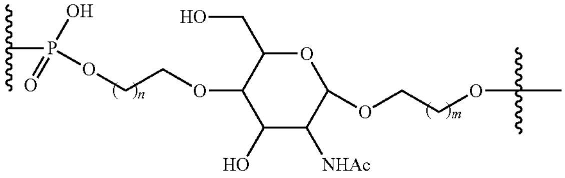
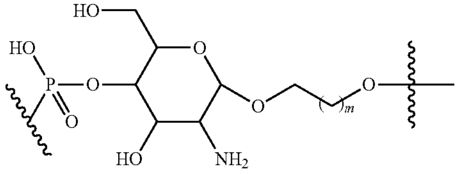
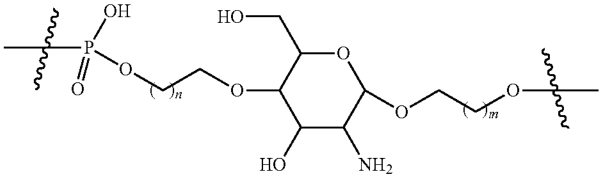
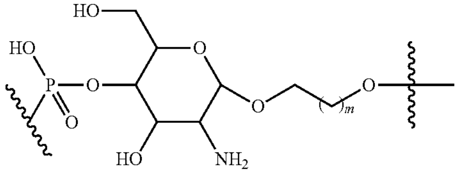
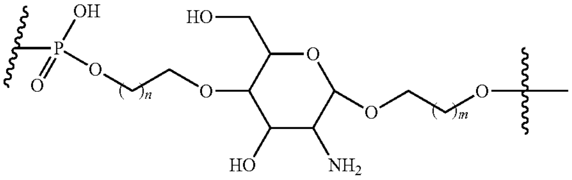
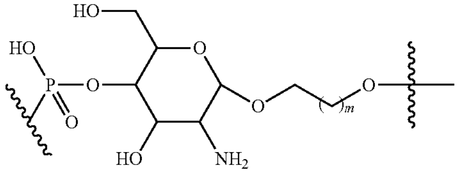
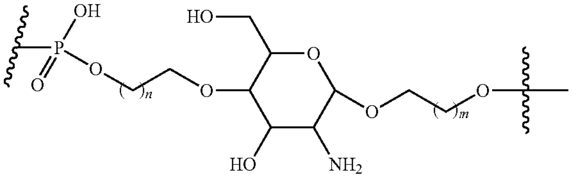
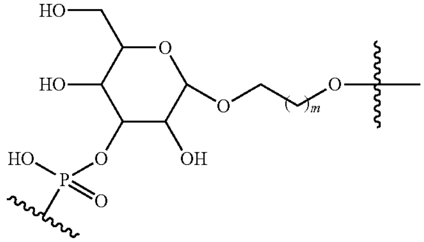
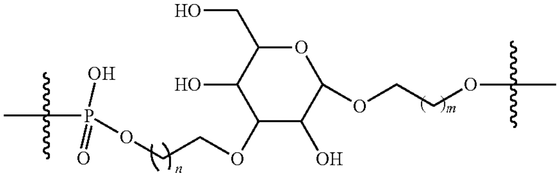
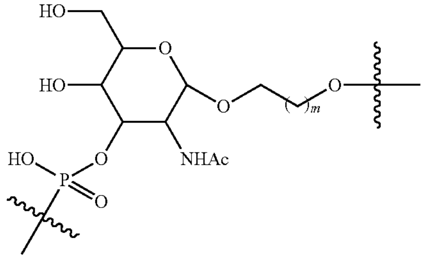
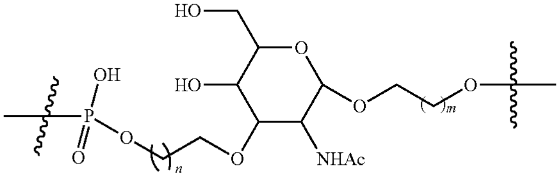
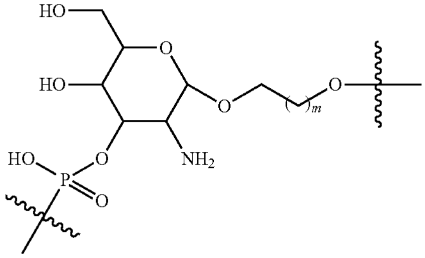
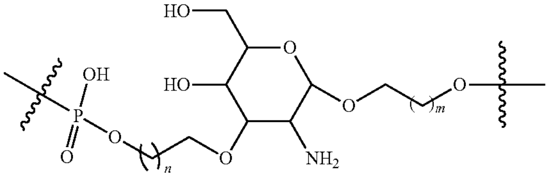

-continued
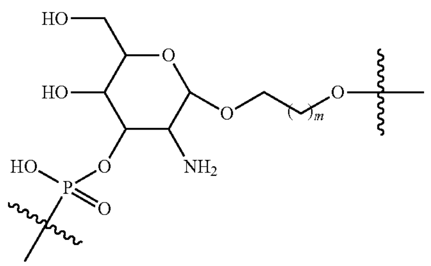
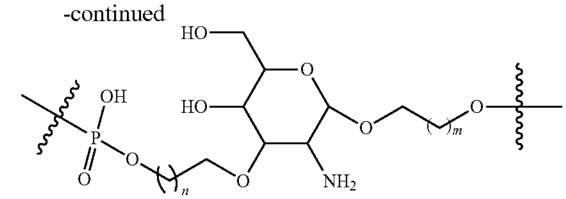
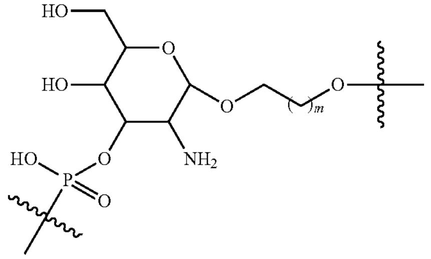
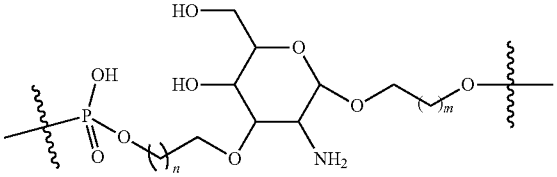
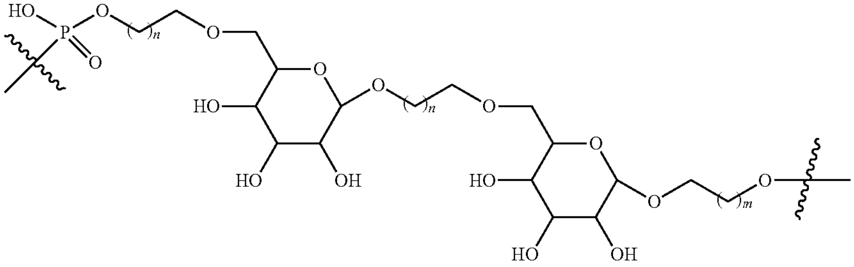
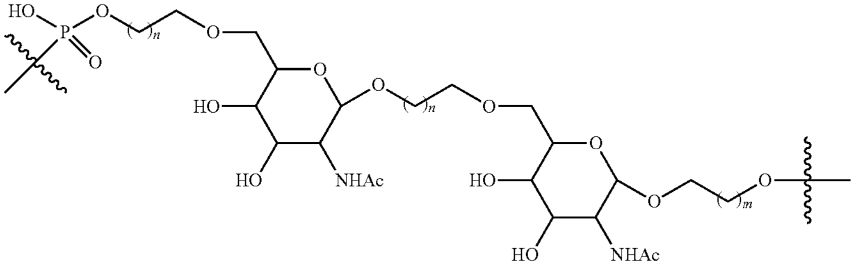
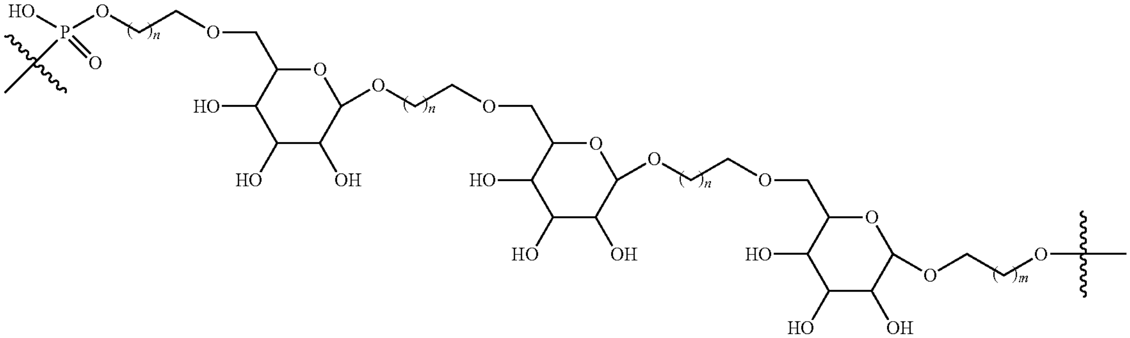
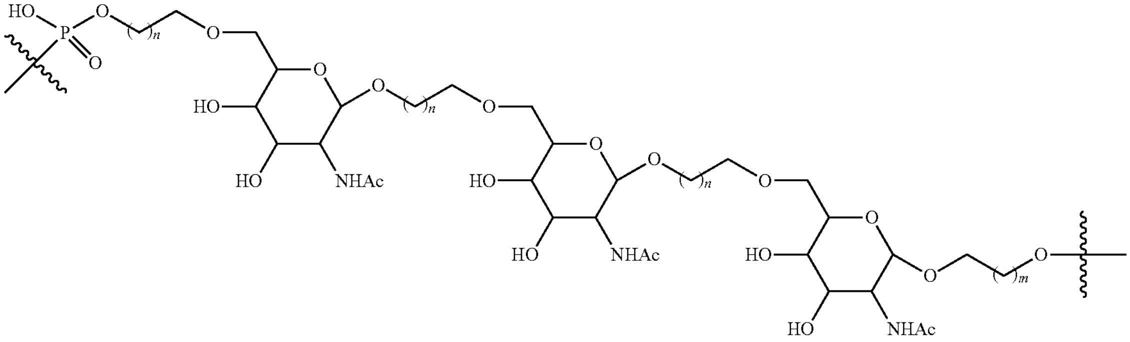

-continued
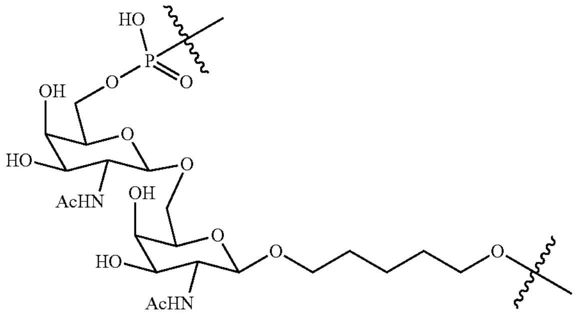
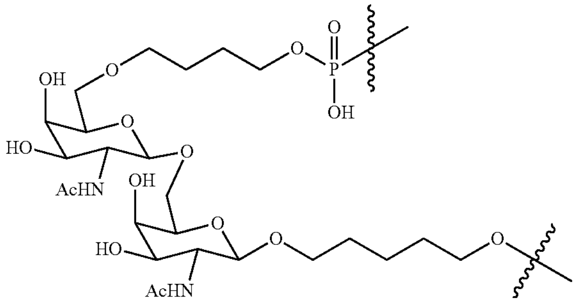
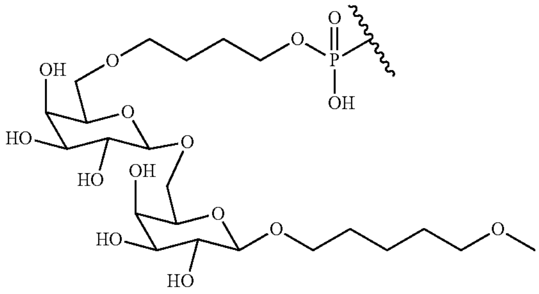
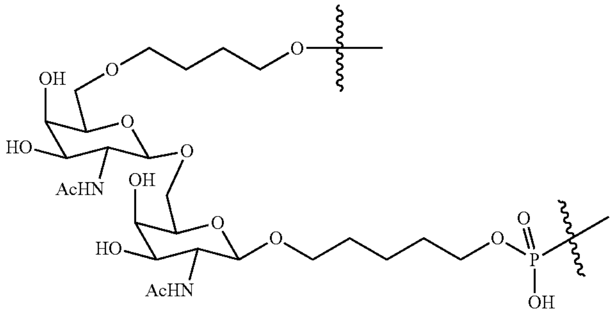
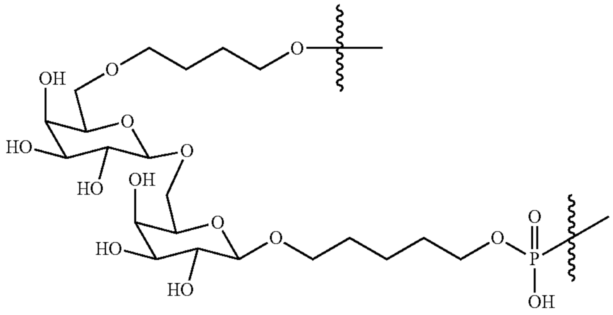
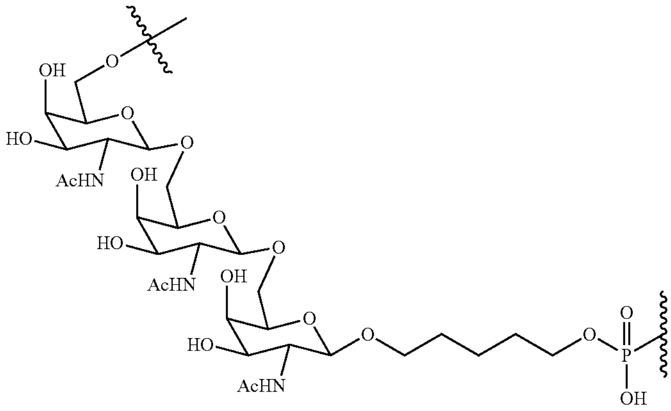

-continued
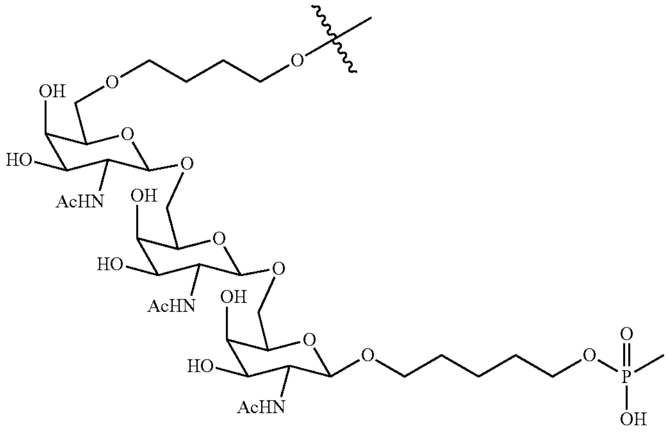
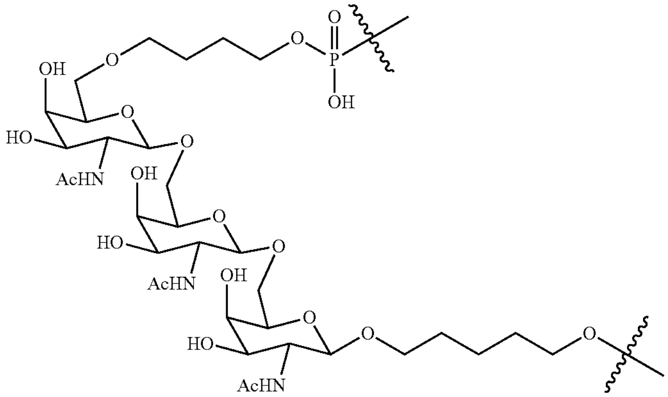
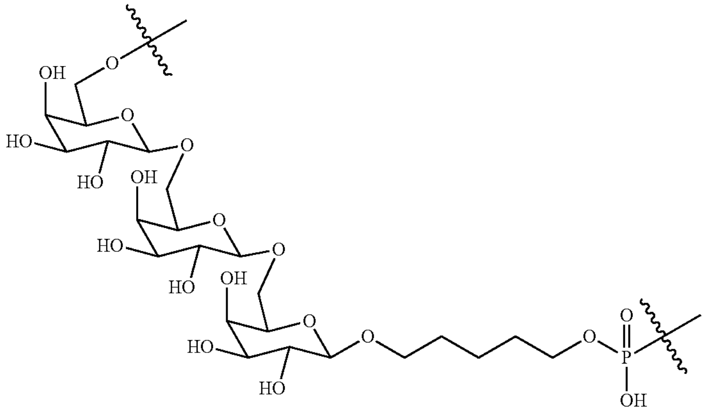
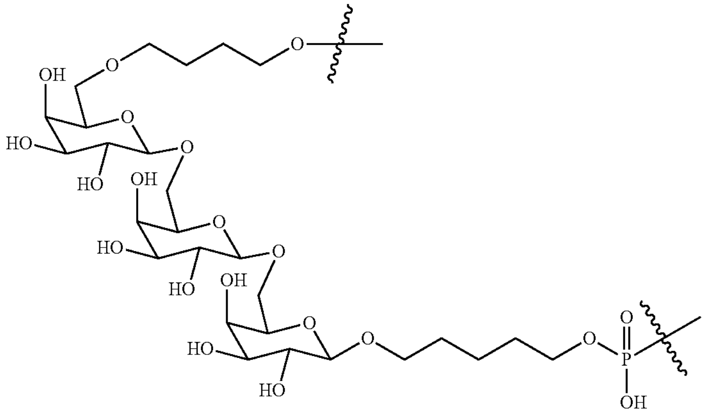

-continued
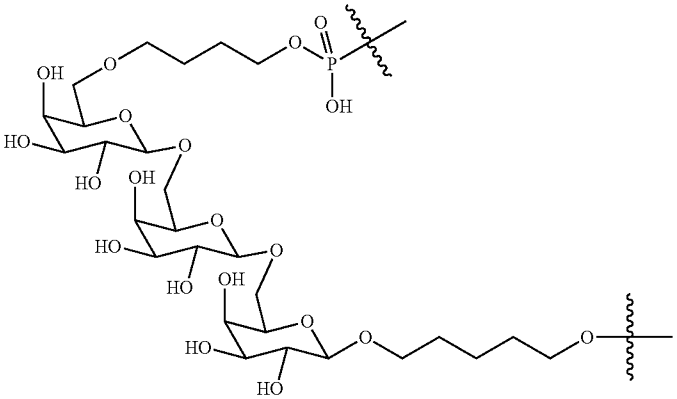
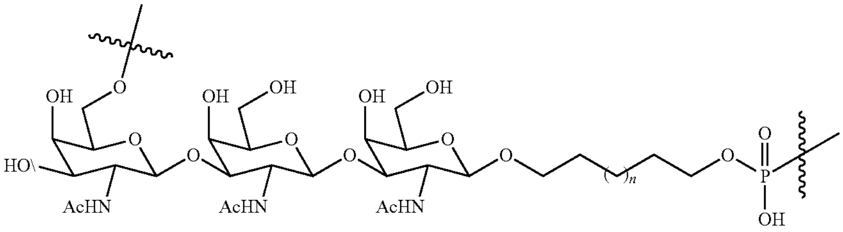
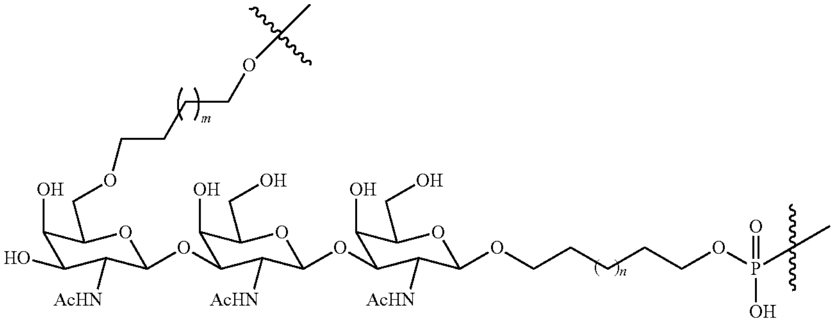
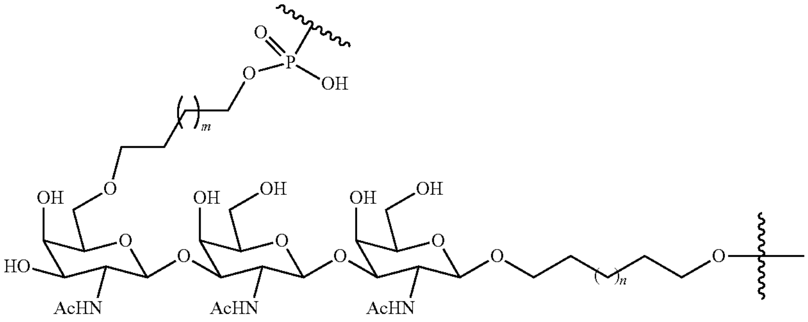
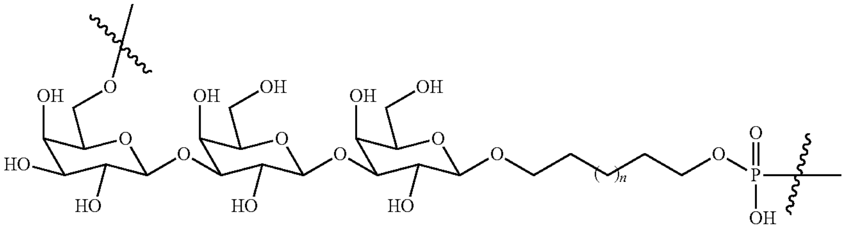

-continued
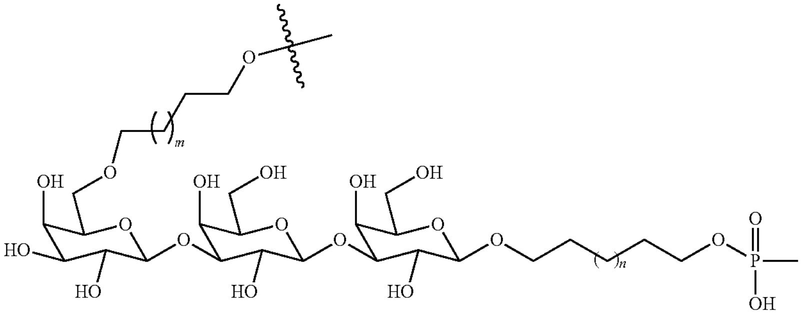
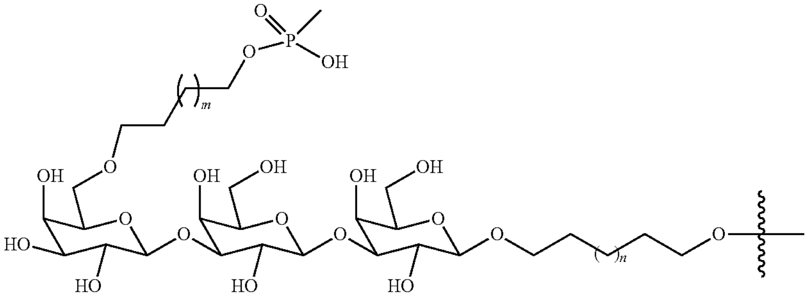
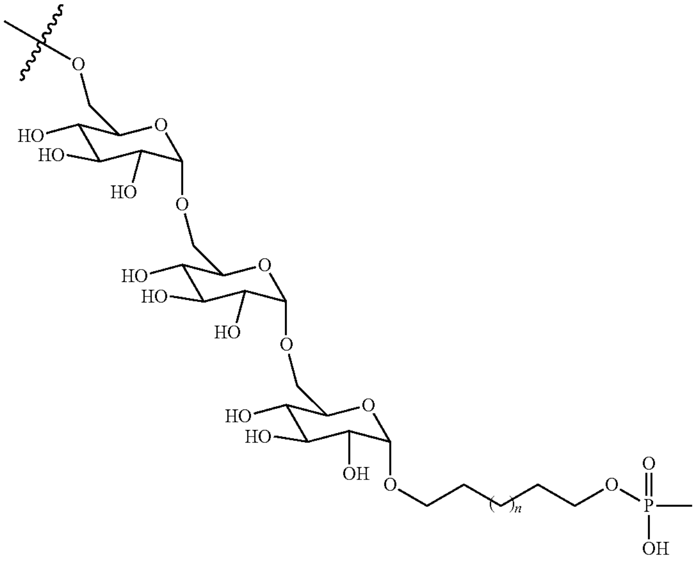

-continued
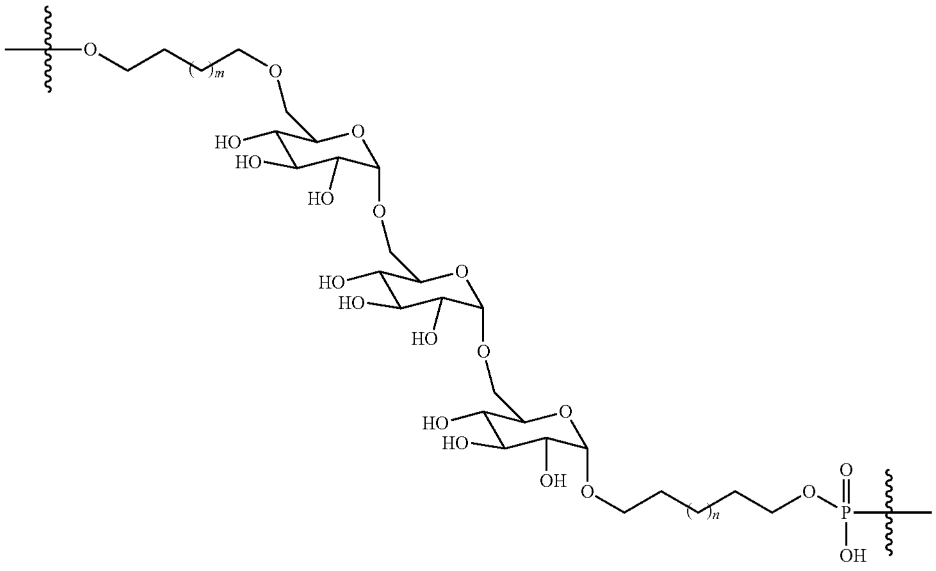
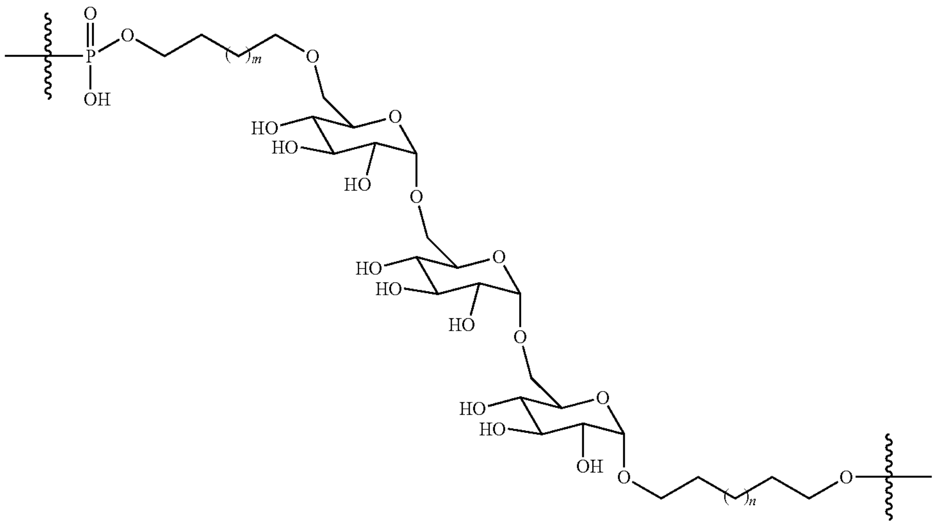
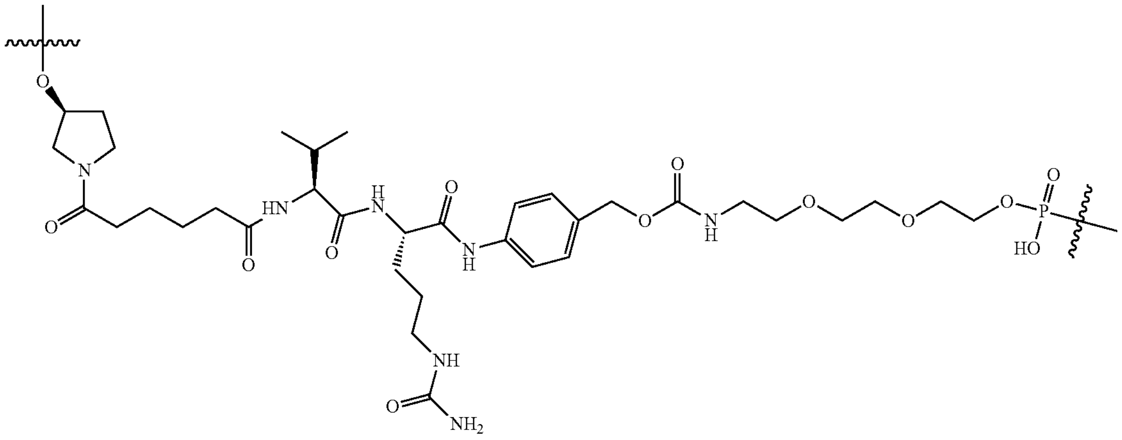
and

-continued

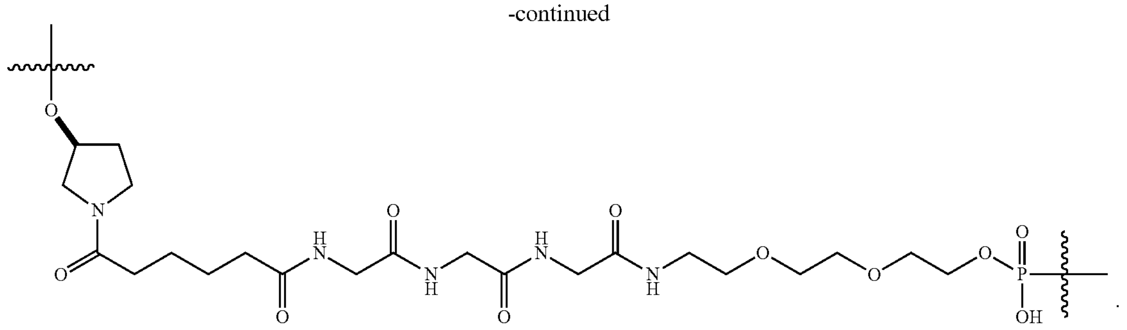

Additional exemplary bio-cleavable linkers are illustrated in Schemes 28-30.

More discussion about the biocleavable linkers may be found in PCT application No. PCT/US18/14213, entitled "Endosomal Cleavable Linkers," filed on Jan. 18, 2018, the content of which is incorporated herein by reference in its entirety.

C. Carriers

In certain embodiments, the lipophilic moiety is conjugated to the iRNA agent via a carrier that replaces one or more nucleotide(s).

The carrier can be a cyclic group or an acyclic group. In one embodiment, the cyclic group is selected from the group consisting of pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin. In one embodiment, the acyclic group is a moiety based on a serinol backbone or a diethanolamine backbone.

In some embodiments, the carrier replaces one or more nucleotide(s) in the internal position(s) of the double-stranded iRNA agent. In some embodiments, the carrier replaces one or more nucleotide(s) within the double stranded portion of the double-stranded iRNA agent.

In other embodiments, the carrier replaces the nucleotides at the terminal end of the sense strand or antisense strand. In one embodiment, the carrier replaces the terminal nucleotide on the 3' end of the sense strand, thereby functioning as an end cap protecting the 3' end of the sense strand. In one embodiment, the carrier is a cyclic group having an amine, for instance, the carrier may be pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, or decalinyl.

A ribonucleotide subunit in which the ribose sugar of the subunit has been so replaced is referred to herein as a ribose replacement modification subunit (RRMS). The carrier can be a cyclic or acyclic moiety and include two "backbone attachment points" (e.g., hydroxyl groups) and a ligand (e.g., the lipophilic moiety). The lipophilic moiety can be directly attached to the carrier or indirectly attached to the carrier by an intervening linker/tether, as described above.

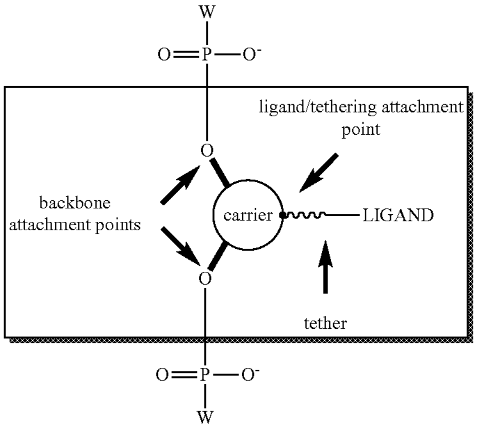

The ligand-conjugated monomer subunit may be the 5' or 3' terminal subunit of the iRNA molecule, i.e., one of the two "W" groups may be a hydroxyl group, and the other "W" group may be a chain of two or more unmodified or modified ribonucleotides. Alternatively, the ligand-conjugated monomer subunit may occupy an internal position, or a position within the double stranded region, and both "W" groups may be one or more unmodified or modified ribonucleotides. More than one ligand-conjugated monomer subunit may be present in an iRNA agent.

i. Sugar Replacement-Based Monomers, e.g., Ligand-Conjugated Monomers (Cyclic)

Cyclic sugar replacement-based monomers, e.g., sugar replacement-based ligand-conjugated monomers, are also referred to herein as RRMS monomer compounds. The carriers may have the general formula (LCM-2) provided below (In that structure preferred backbone attachment points can be chosen from $R^1$ or $R^2$; $R^3$ or $R^4$; or $R^9$ and $R^{10}$ if Y is $CR^9R^{10}$ (two positions are chosen to give two backbone attachment points, e.g., $R^1$ and $R^4$, or $R^4$ and $R^9$)). Preferred tethering attachment points include $R^7$; $R^5$ or $R^6$ when X is $CH_2$. The carriers are described below as an entity, which can be incorporated into a strand. Thus, it is understood that the structures also encompass the situations wherein one (in the case of a terminal position) or two (in the case of an internal position) of the attachment points, e.g., $R^1$ or $R^2$; $R^3$ or $R^4$; or $R^9$ or $R^{10}$ (when Y is $CR^9R^{10}$), is connected to the phosphate, or modified phosphate, e.g., sulfur containing, backbone. E.g., one of the above-named R groups can be $—CH_2—$, wherein one bond is connected to the carrier and one to a backbone atom, e.g., a linking oxygen or a central phosphorus atom.

(LCM-2)

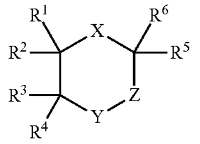

wherein:

X is $N(CO)R^7$, $NR^7$ or $CH_2$;

Y is $NR^8$, O, S, $CR^9R^{10}$;

Z is $CR^{11}R^{12}$ or absent;

Each of $R^1$, $R^2$, $R^3$, $R^4$, $R^9$, and $R^{10}$ is, independently, H, $OR^a$, or $(CH_2)_nOR^b$, provided that at least two of $R^1$, $R^2$, $R^3$, $R^4$, $R^9$, and $R^{10}$ are $OR^a$ or $(CH_2)_nOR^b$;

Each of $R^5$, $R^6$, $R^{11}$, and $R^{12}$ is, independently, a ligand, H, $C_1$-$C_6$ alkyl optionally substituted with 1-3 $R^{13}$, or $C(O)NHR^7$; or $R^5$ and $R^{11}$ together are $C_3$-$C_8$ cycloalkyl optionally substituted with $R^{14}$;

$R^7$ can be a ligand, e.g., $R^7$ can be $R^d$, or $R^7$ can be a ligand tethered indirectly to the carrier, e.g., through a tethering moiety, e.g., $C_1$-$C_{20}$ alkyl substituted with $NR^cR^d$; or $C_1$-$C_{20}$ alkyl substituted with $NHC(O)R^d$;

$R^8$ is H or $C_1$-$C_6$ alkyl;

$R^{13}$ is hydroxy, $C_1$-$C_4$ alkoxy, or halo;

$R^{14}$ is $NR^cR^7$;

$R^{15}$ is $C_1$-$C_6$ alkyl optionally substituted with cyano, or $C_2$-$C_6$ alkenyl;

$R^{16}$ is $C_1$-$C_{10}$ alkyl;

$R^{17}$ is a liquid or solid phase support reagent;

L is —$C(O)(CH_2)_qC(O)$—, or —$C(O)(CH_2)_qS$—;

$R^a$ is a protecting group, e.g., $CAr_3$; (e.g., a dimethoxytrityl group) or $Si(X^{5'})(X^{5''})(X^{5'''})$ in which $(X^{5'})$, $(X^{5''})$, and $(X^{5'''})$ are as described elsewhere.

$R^b$ is $P(O)(O)H$, $P(OR^{15})N(R^{16})_2$ or $L$-$R^{17}$;

$R^c$ is H or $C_1$-$C_6$ alkyl;

$R^d$ is H or a ligand;

Each Ar is, independently, $C_6$-$C_{10}$ aryl optionally substituted with $C_1$-$C_4$ alkoxy;

n is 1-4; and q is 0-4.

Exemplary carriers include those in which, e.g., X is $N(CO)R^7$ or $NR^7$, Y is $CR^9R^{10}$, and Z is absent; or X is $N(CO)R^7$ or $NR^7$, Y is $CR^9R^{10}$, and Z is $CR^{11}R^{12}$; or X is $N(CO)R^7$ or $NR^7$, Y is $NR^8$, and Z is $CR^{11}R^{12}$; or X is $N(CO)R^7$ or $NR^7$, Y is O, and Z is $CR^{11}R^{12}$; or X is $CH_2$; Y is $CR^9R^{10}$; Z is $CR^{11}R^{12}$, and $R^5$ and $R^{11}$ together form $C_6$ cycloalkyl (H, z=2), or the indane ring system, e.g., X is $CH_2$; Y is $CR^9R^{10}$; Z is $CR^{11}R^{12}$, and $R^5$ and $R^{11}$ together form $C_5$ cycloalkyl (H, z=1).

In certain embodiments, the carrier may be based on the pyrroline ring system or the 4-hydroxyproline ring system, e.g., X is $N(CO)R^7$ or $NR^7$, Y is $CR^9R^{10}$, and Z is absent (D).

D

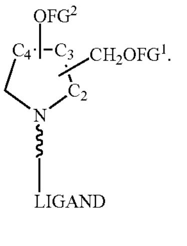

$OFG^1$ is, in some embodiments, attached to a primary carbon, e.g., an exocyclic alkylene group, e.g., a methylene group, connected to one of the carbons in the five-membered ring (—$CH_2OFG^1$ in D). $OFG^2$ is, in some embodiments, attached directly to one of the carbons in the five-membered ring (—$OFG^2$ in D). For the pyrroline-based carriers, —$CH_2OFG^1$ may be attached to C-2 and $OFG^2$ may be attached to C-3; or —$CH_2OFG^1$ may be attached to C-3 and $OFG^2$ may be attached to C-4. In certain embodiments, $CH_2OFG^1$ and $OFG^2$ may be geminally substituted to one of the above-referenced carbons. For the 3-hydroxyproline-based carriers, —$CH_2OFG^1$ may be attached to C-2 and $OFG^2$ may be attached to C-4. The pyrroline- and 4-hydroxyproline-based monomers may therefore contain linkages (e.g., carbon-carbon bonds) wherein bond rotation is restricted about that particular linkage, e.g. restriction resulting from the presence of a ring. Thus, $CH_2OFG^1$ and $OFG^2$ may be cis or trans with respect to one another in any of the pairings delineated above Accordingly, all cis/trans isomers are expressly included. The monomers may also contain one or more asymmetric centers and thus occur as racemates and racemic mixtures, single enantiomers, individual diastereomers and diastereomeric mixtures. All such isomeric forms of the monomers are expressly included (e.g., the centers bearing $CH_2OFG^1$ and $OFG^2$ can both have the R configuration; or both have the S configuration; or one center can have the R configuration and the other center can have the S configuration and vice versa). The tethering attachment point is, in some embodiments, nitrogen. Preferred examples of carrier D include the following:

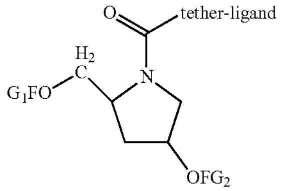

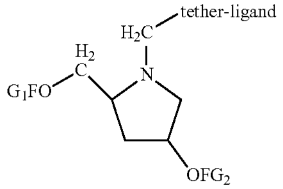

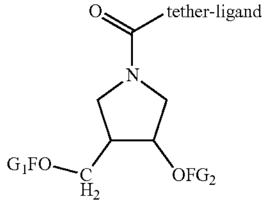

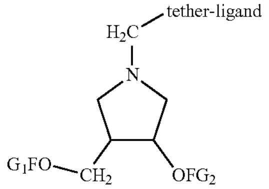

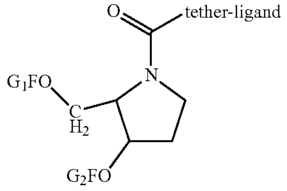

-continued

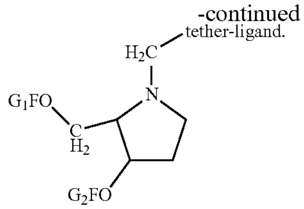

In certain embodiments, the carrier may be based on the piperidine ring system (E), e.g., X is N(CO)$R^7$ or $NR^7$, Y is $CR^9R^{10}$, and Z is $CR^{11}R^{12}$.

E

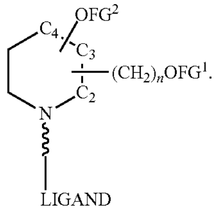

$OFG^1$ is, in some embodiments, attached to a primary carbon, e.g., an exocyclic alkylene group, e.g., a methylene group (n=1) or ethylene group (n=2), connected to one of the carbons in the six-membered ring [—$(CH_2)_nOFG^1$ in E]. $OFG^2$ is, in some embodiments, attached directly to one of the carbons in the six-membered ring (—$OFG^2$ in E). —$(CH_2)_nOFG^1$ and $OFG^2$ may be disposed in a geminal manner on the ring, i.e., both groups may be attached to the same carbon, e.g., at C-2, C-3, or C-4. Alternatively, —$(CH_2)_nOFG^1$ and $OFG^2$ may be disposed in a vicinal manner on the ring, i.e., both groups may be attached to adjacent ring carbon atoms, e.g., —$(CH_2)_nOFG^1$ may be attached to C-2 and $OFG^2$ may be attached to C-3; —$(CH_2)_n$ $OFG^1$ may be attached to C-3 and $OFG^2$ may be attached to C-2; —$(CH_2)_nOFG^1$ may be attached to C-3 and $OFG^2$ may be attached to C-4; or —$(CH_2)_nOFG^1$ may be attached to C-4 and $OFG^2$ may be attached to C-3. The piperidine-based monomers may therefore contain linkages (e.g., carbon-carbon bonds) wherein bond rotation is restricted about that particular linkage, e.g. restriction resulting from the presence of a ring. Thus, —$(CH_2)_nOFG^1$ and $OFG^2$ may be cis or trans with respect to one another in any of the pairings delineated above. Accordingly, all cis/trans isomers are expressly included. The monomers may also contain one or more asymmetric centers and thus occur as racemates and racemic mixtures, single enantiomers, individual diastereomers and diastereomeric mixtures. All such isomeric forms of the monomers are expressly included (e.g., the centers bearing $CH_2OFG^1$ and $OFG^2$ can both have the R configuration; or both have the S configuration; or one center can have the R configuration and the other center can have the S configuration and vice versa). The tethering attachment point is, in some embodiments, nitrogen.

In certain embodiments, the carrier may be based on the piperazine ring system (F), e.g., X is N(CO)$R^7$ or $NR^7$, Y is $NR^8$, and Z is $CR^{11}R^{12}$, or the morpholine ring system (G), e.g., X is N(CO)$R^7$ or $NR^7$, Y is O, and Z is $CR^{11}R^{12}$.

F

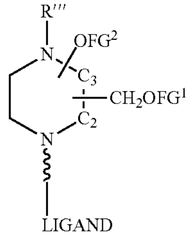

G

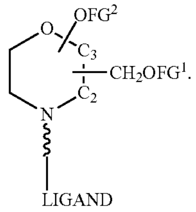

$OFG^1$ is, in some embodiments, attached to a primary carbon, e.g., an exocyclic alkylene group, e.g., a methylene group, connected to one of the carbons in the six-membered ring (—$CH_2OFG^1$ in F or G). $OFG^2$ is, in some embodiments, attached directly to one of the carbons in the six-membered rings (—$OFG^2$ in F or G). For both F and G, —$CH_2OFG^1$ may be attached to C-2 and $OFG^2$ may be attached to C-3; or vice versa. In certain embodiments, $CH_2OFG^1$ and $OFG^2$ may be geminally substituted to one of the above-referenced carbons. The piperazine- and morpholine-based monomers may therefore contain linkages (e.g., carbon-carbon bonds) wherein bond rotation is restricted about that particular linkage, e.g. restriction resulting from the presence of a ring. Thus, $CH_2OFG^1$ and $OFG^2$ may be cis or trans with respect to one another in any of the pairings delineated above. Accordingly, all cis/trans isomers are expressly included. The monomers may also contain one or more asymmetric centers and thus occur as racemates and racemic mixtures, single enantiomers, individual diastereomers and diastereomeric mixtures. All such isomeric forms of the monomers are expressly included (e.g., the centers bearing $CH_2OFG^1$ and $OFG^2$ can both have the R configuration; or both have the S configuration; or one center can have the R configuration and the other center can have the S configuration and vice versa). R''' can be, e.g., $C_1$-$C_6$ alkyl, or $CH_3$. The tethering attachment point is, in some embodiments, nitrogen in both F and G.

In certain embodiments, the carrier may be based on the decalin ring system, e.g., X is $CH_2$; Y is $CR^9R^{10}$; Z is $CR^{11}R^{12}$, and $R^5$ and $R^{11}$ together form $C_6$ cycloalkyl (H, z=2), or the indane ring system e.g., X is $CH_2$; Y is $CR^9R^{10}$; Z is $CR^{11}R^{12}$, and $R^5$ and $R^{11}$ together form $C_5$ cycloalkyl (H, z=1).

H

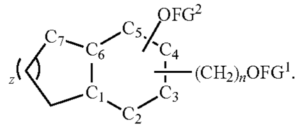

$OFG^1$ is, in some embodiments, attached to a primary carbon, e.g., an exocyclic methylene group (n=1) or ethylene group (n=2) connected to one of C-2, C-3, C-4, or C-5 [—$(CH_2)_nOFG^1$ in H]. $OFG^2$ is, in some embodiments, attached directly to one of C-2, C-3, C-4, or C-5 (—$OFG^2$ in H). —$(CH_2)_nOFG^1$ and $OFG^2$ may be disposed in a geminal manner on the ring, i.e., both groups may be attached to the same carbon, e.g., at C-2, C-3, C-4, or C-5. Alternatively, —$(CH_2)_nOFG^1$ and $OFG^2$ may be disposed in a vicinal manner on the ring, i.e., both groups may be attached to adjacent ring carbon atoms, e.g., —$(CH_2)_nOFG^1$ may be attached to C-2 and $OFG^2$ may be attached to C-3; —$(CH_2)_nOFG^1$ may be attached to C-3 and $OFG^2$ may be attached to C-2; —$(CH_2)_nOFG^1$ may be attached to C-3 and $OFG^2$ may be attached to C-4; or —$(CH_2)_nOFG^1$ may be attached to C-4 and $OFG^2$ may be attached to C-3; —$(CH_2)_n$ $OFG^1$ may be attached to C-4 and $OFG^2$ may be attached to C-5; or —$(CH_2)_nOFG^1$ may be attached to C-5 and $OFG^2$ may be attached to C-4. The decalin or indane-based monomers may therefore contain linkages (e.g., carbon-carbon bonds) wherein bond rotation is restricted about that particular linkage, e.g. restriction resulting from the presence of a ring. Thus, —$(CH_2)_nOFG^1$ and $OFG^2$ may be cis or trans with respect to one another in any of the pairings delineated above. Accordingly, all cis/trans isomers are expressly included. The monomers may also contain one or more asymmetric centers and thus occur as racemates and racemic mixtures, single enantiomers, individual diastereomers and diastereomeric mixtures. All such isomeric forms of the monomers are expressly included (e.g., the centers bearing $CH_2OFG^1$ and $OFG^2$ can both have the R configuration; or both have the S configuration; or one center can have the R configuration and the other center can have the S configuration and vice versa). In a preferred embodiment, the substituents at C-1 and C-6 are trans with respect to one another. The tethering attachment point is, in some embodiments, C-6 or C-7.

Other carriers may include those based on 3-hydroxyproline (J).

J

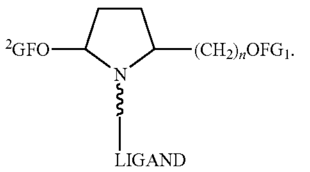

Thus, —$(CH_2)_nOFG^1$ and $OFG^2$ may be cis or trans with respect to one another. Accordingly, all cis/trans isomers are expressly included. The monomers may also contain one or more asymmetric centers and thus occur as racemates and racemic mixtures, single enantiomers, individual diastereomers and diastereomeric mixtures. All such isomeric forms of the monomers are expressly included (e.g., the centers bearing $CH_2OFG^1$ and $OFG^2$ can both have the R configuration; or both have the S configuration; or one center can have the R configuration and the other center can have the S configuration and vice versa). The tethering attachment point is, in some embodiments, nitrogen.

Details about more representative cyclic, sugar replacement-based carriers can be found in U.S. Pat. Nos. 7,745,608 and 8,017,762, which are herein incorporated by reference in their entireties.

ii. Sugar Replacement-Based Monomers (Acyclic)

Acyclic sugar replacement-based monomers, e.g., sugar replacement-based ligand-conjugated monomers, are also referred to herein as ribose replacement monomer subunit (RRMS) monomer compounds. Preferred acyclic carriers can have formula LCM-3 or LCM-4:

LCM-3

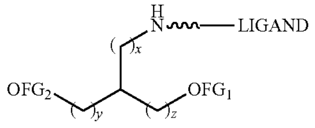

LCM-4

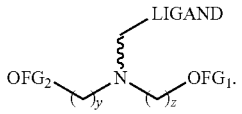

In some embodiments, each of x, y, and z can be, independently of one another, 0, 1, 2, or 3. In formula LCM-3, when y and z are different, then the tertiary carbon can have either the R or S configuration. In preferred embodiments, x is zero and y and z are each 1 in formula LCM-3 (e.g., based on serinol), and y and z are each 1 in formula LCM-3. Each of formula LCM-3 or LCM-4 below can optionally be substituted, e.g., with hydroxy, alkoxy, perhaloalkyl.

Details about more representative acyclic, sugar replacement-based carriers can be found in U.S. Pat. Nos. 7,745,608 and 8,017,762, which are herein incorporated by reference in their entireties.

In some embodiments, the double stranded iRNA agent comprises one or more lipophilic moieties conjugated to the 5' end of the sense strand or the 5' end of the antisense strand.

In certain embodiments, the lipophilic moiety is conjugated to the 5'-end of a strand via a carrier or linker. In one embodiment, the lipophilic moiety is conjugated to the 5'-end of a strand via a carrier of a formula:

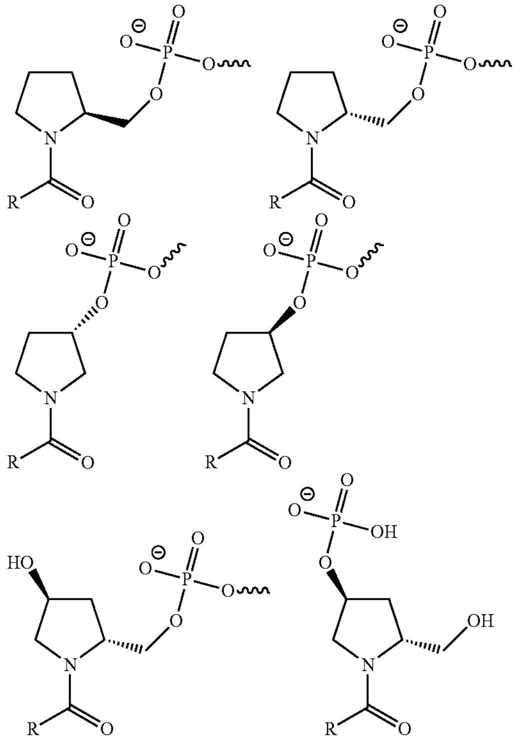

-continued

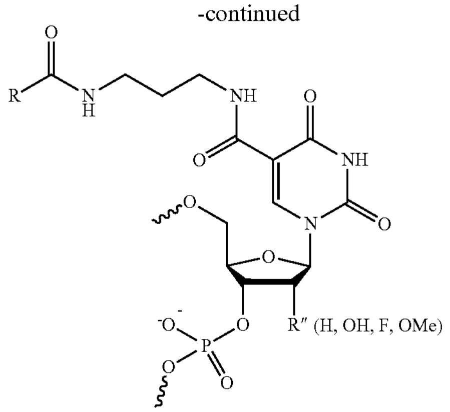

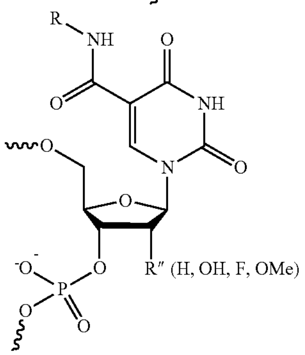

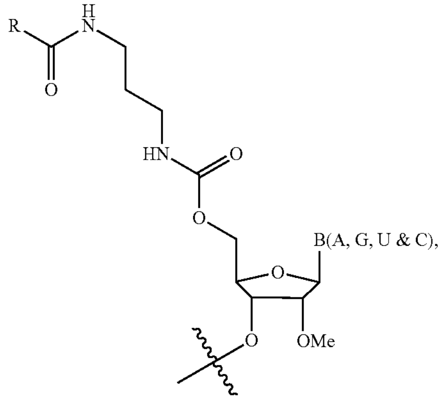

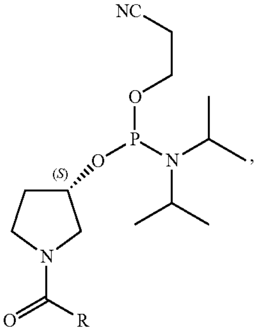

, or

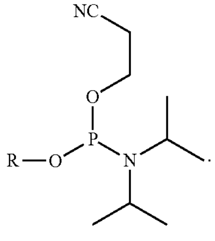

.

R is a ligand such as the lipophilic moiety.

In some embodiments, the double stranded iRNA agent comprises one or more lipophilic moieties conjugated to the 3' end of the sense strand or the 3' end of the antisense strand.

In certain embodiments, the lipophilic moiety is conjugated to the 3'-end of a strand via a carrier and/or linker. In one embodiment, the lipophilic moiety is conjugated to the 3'-end of a strand via a carrier of a formula:

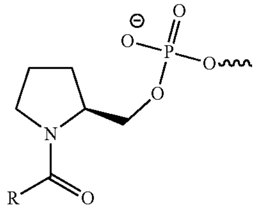

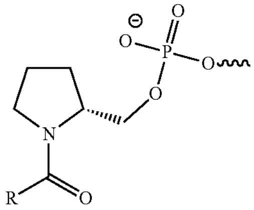

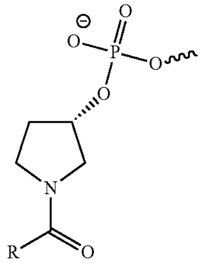

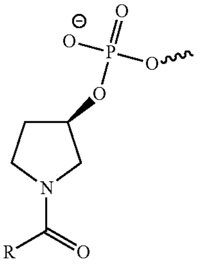

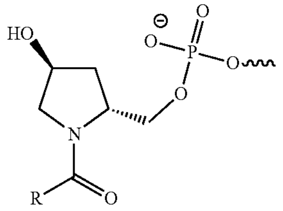

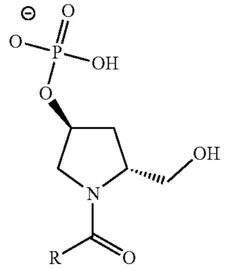

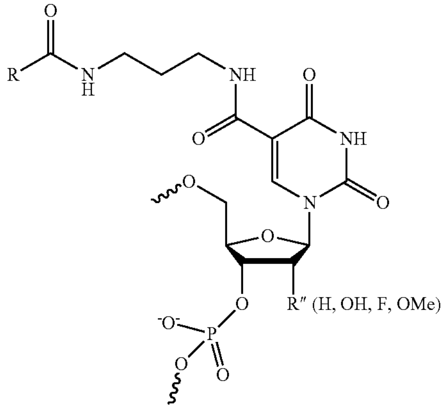

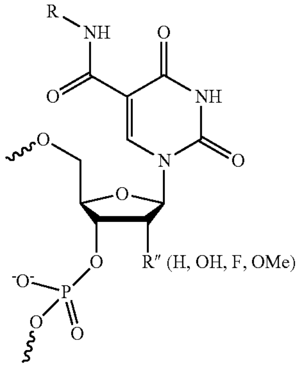

-continued

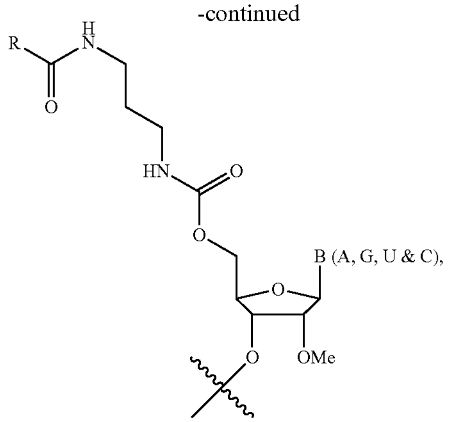

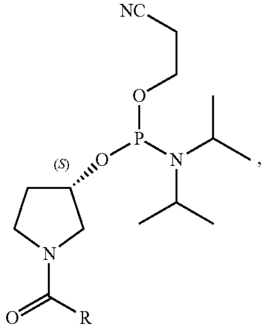

, or

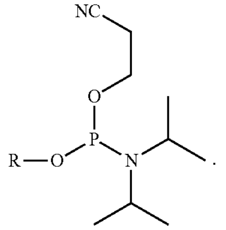

R is a ligand such as the lipophilic moiety.

In some embodiments, the double stranded iRNA agent comprises one or more lipophilic moieties conjugated to both ends of the sense strand.

In some embodiments, the double stranded iRNA agent comprises one or more lipophilic moieties conjugated to both ends of the antisense strand.

In some embodiments, the double stranded iRNA agent comprises one or more lipophilic moieties conjugated to the 5' end or 3' end of the sense strand, and one or more lipophilic moieties conjugated to the 5' end or 3' end of the antisense strand, In some embodiments, the lipophilic moiety is conjugated to the terminal end of a strand via one or more linkers (tethers) or a carrier.

In one embodiment, the lipophilic moiety is conjugated to the terminal end of a strand via one or more linkers (tethers).

In one embodiment, the lipophilic moiety is conjugated to the 5' end of the sense strand or antisense strand via a cyclic carrier, optionally via one or more intervening linkers (tethers).

In some embodiments, the lipophilic moiety is conjugated to one or more internal positions on at least one strand. Internal positions of a strand refers to the nucleotide on any position of the strand, except the terminal position from the 3' end and 5' end of the strand (e.g., excluding 2 positions: position 1 counting from the 3' end and position 1 counting from the 5' end).

In one embodiment, the lipophilic moiety is conjugated to one or more internal positions on at least one strand, which include all positions except the terminal two positions from each end of the strand (e.g., excluding 4 positions: positions 1 and 2 counting from the 3' end and positions 1 and 2 counting from the 5' end). In one embodiment, the lipophilic moiety is conjugated to one or more internal positions on at least one strand, which include all positions except the terminal three positions from each end of the strand (e.g., excluding 6 positions: positions 1, 2, and 3 counting from the 3' end and positions 1, 2, and 3 counting from the 5' end).

In one embodiment, the lipophilic moiety is conjugated to one or more internal positions on at least one strand, except the cleavage site region of the sense strand, for instance, the lipophilic moiety is not conjugated to positions 9-12 counting from the 5'-end of the sense strand. Alternatively, the internal positions exclude positions 11-13 counting from the 3'-end of the sense strand.

In one embodiment, the lipophilic moiety is conjugated to one or more internal positions on at least one strand, which exclude the cleavage site region of the antisense strand. For instance, the internal positions exclude positions 12-14 counting from the 5'-end of the antisense strand.

In one embodiment, the lipophilic moiety is conjugated to one or more internal positions on at least one strand, which exclude positions 11-13 on the sense strand, counting from the 3'-end, and positions 12-14 on the antisense strand, counting from the 5'-end.

In one embodiment, one or more lipophilic moieties are conjugated to one or more of the following internal positions: positions 4-8 and 13-18 on the sense strand, and positions 6-10 and 15-18 on the antisense strand, counting from the 5'end of each strand.

In one embodiment, one or more lipophilic moieties are conjugated to one or more of the following internal positions: positions 5, 6, 7, 15, and 17 on the sense strand, and positions 15 and 17 on the antisense strand, counting from the 5'end of each strand.

In some embodiments, the lipophilic moiety is conjugated to one or more positions in the double stranded region on at least one strand. The double stranded region does not include single stranded overhang or hairpin loop regions.

In some embodiments, the lipophilic moiety is conjugated to a nucleobase, sugar moiety, or internucleosidic linkage of the double-stranded iRNA agent.

Conjugation to purine nucleobases or derivatives thereof can occur at any position including, endocyclic and exocyclic atoms. In some embodiments, the 2-, 6-, 7-, or 8-positions of a purine nucleobase are attached to a conjugate moiety. Conjugation to pyrimidine nucleobases or derivatives thereof can also occur at any position. In some embodiments, the 2-, 5-, and 6-positions of a pyrimidine nucleobase can be substituted with a conjugate moiety. When a lipophilic moiety is conjugated to a nucleobase, the preferred position is one that does not interfere with hybridization, i.e., does not interfere with the hydrogen bonding interactions needed for base pairing. In one embodiment, the lipophilic moieties may be conjugated to a nucleobase via a linker containing an alkyl, alkenyl or amide linkage. Exemplary conjugations of the lipophilic moieties to the nucleobase are illustrated in FIG. 1 and Example 7.

Conjugation to sugar moieties of nucleosides can occur at any carbon atom. Exemplary carbon atoms of a sugar moiety that a lipophilic moiety can be attached to include the 2', 3', and 5' carbon atoms. A lipophilic moiety can also be attached to the 1' position, such as in an abasic residue. In one embodiment, the lipophilic moieties may be conjugated to a sugar moiety, via a 2'-O modification, with or without a linker. Exemplary conjugations of the lipophilic moieties to the sugar moiety (via a 2'-O modification) are illustrated in FIG. 1 and Examples 1, 2, 3, and 6.

Internucleosidic linkages can also bear lipophilic moieties. For phosphorus-containing linkages (e.g., phosphodiester, phosphorothioate, phosphorodithiotate, phosphoroamidate, and the like), the lipophilic moiety can be attached directly to the phosphorus atom or to an O, N, or S atom bound to the phosphorus atom. For amine- or amide-containing internucleosidic linkages (e.g., PNA), the lipophilic moiety can be attached to the nitrogen atom of the amine or amide or to an adjacent carbon atom.

There are numerous methods for preparing conjugates of oligonuclotides. Generally, an oligonucleotide is attached to a conjugate moiety by contacting a reactive group (e.g., OH, SH, amine, carboxyl, aldehyde, and the like) on the oligonucleotide with a reactive group on the conjugate moiety. In some embodiments, one reactive group is electrophilic and the other is nucleophilic.

For example, an electrophilic group can be a carbonyl-containing functionality and a nucleophilic group can be an amine or thiol. Methods for conjugation of nucleic acids and related oligomeric compounds with and without linking groups are well described in the literature such as, for example, in Manoharan in Antisense Research and Applications, Crooke and LeBleu, eds., CRC Press, Boca Raton, Fla., 1993, Chapter 17, which is incorporated herein by reference in its entirety.

In one embodiment, a first (complementary) RNA strand and a second (sense) RNA strand can be synthesized separately, wherein one of the RNA strands comprises a pendant lipophilic moiety, and the first and second RNA strands can be mixed to form a dsRNA. The step of synthesizing the RNA strand may involve solid-phase synthesis, wherein individual nucleotides are joined end to end through the formation of internucleotide 3'-5' phosphodiester bonds in consecutive synthesis cycles.

In one embodiment, a lipophilic molecule having a phosphoramidite group is coupled to the 3'-end or 5'-end of either the first (complementary) or second (sense) RNA strand in the last synthesis cycle. In the solid-phase synthesis of an RNA, the nucleotides are initially in the form of nucleoside phosphoramidites. In each synthesis cycle, a further nucleoside phosphoramidite is linked to the —OH group of the previously incorporated nucleotide. If the lipophilic molecule has a phosphoramidite group, it can be coupled in a manner similar to a nucleoside phosphoramidite to the free OH end of the RNA synthesized previously in the solid-phase synthesis. The synthesis can take place in an automated and standardized manner using a conventional RNA synthesizer. Synthesis of the lipophilic molecule having the phosphoramidite group may include phosphitylation of a free hydroxyl to generate the phosphoramidite group.

Synthesis procedures of lipophilic moiety-conjugated phosphoramidites are exemplified in the Examples provided herein as are procedures of post-synthesis conjugation of liphophilic moieties or other ligands.

In general, the oligonucleotides can be synthesized using protocols known in the art, for example, as described in Caruthers et al., *Methods in Enzymology* (1992) 211:3-19; WO 99/54459; Wincott et al., Nucl. Acids Res. (1995) 23:2677-2684; Wincott et al., *Methods Mol. Bio*., (1997) 74:59; Brennan et al., *Biotechnol. Bioeng.* (1998) 61:33-45; and U.S. Pat. No. 6,001,311; each of which is hereby incorporated by reference in its entirety. In general, the synthesis of oligonucleotides involves conventional nucleic acid protecting and coupling groups, such as dimethoxytrityl at the 5'-end, and phosphoramidites at the 3'-end. In a non-limiting example, small scale syntheses are conducted on an Expedite 8909 RNA synthesizer sold by Applied Biosystems, Inc. (Weiterstadt, Germany), using ribonucleoside phosphoramidites sold by ChemGenes Corporation (Ashland, Mass.). Alternatively, syntheses can be performed on a 96-well plate synthesizer, such as the instrument produced by Protogene (Palo Alto, Calif.), or by methods such as those described in Usman et al., *J. Am. Chem. Soc.* (1987) 109:7845; Scaringe, et al., *Nucl. Acids Res.* (1990) 18:5433; Wincott, et al., *Nucl. Acids Res.* (1990) 23:2677-2684; and Wincott, et al., *Methods Mol. Bio*. (1997) 74:59, each of which is hereby incorporated by reference in its entirety.

The nucleic acid molecules of the present invention may be synthesized separately and joined together post-synthetically, for example, by ligation (Moore et al., *Science* (1992) 256:9923; WO 93/23569; Shabarova et al., *Nucl. Acids Res.* (1991) 19:4247; Bellon et al., *Nucleosides & Nucleotides* (1997) 16:951; Bellon et al., *Bioconjugate Chem.* (1997) 8:204; or by hybridization following synthesis or deprotection. The nucleic acid molecules can be purified by gel electrophoresis using conventional methods or can be purified by high pressure liquid chromatography (HPLC; see Wincott et al., supra, the totality of which is hereby incorporated herein by reference) and re-suspended in water.

III. IRNAS OF THE INVENTION

The present invention provides iRNAs which selectively inhibit the expression of one or more complement component C3 genes. In one embodiment, the iRNA agent includes double stranded ribonucleic acid (dsRNA) molecules for inhibiting the expression of a C3 gene in an ocular cell, such as an ocular cell within a subject, e.g., a mammal, such as a human having a C3-associated ocular disease. In another embodiment, the iRNA agent includes double stranded ribonucleic acid (dsRNA) molecules for inhibiting the expression of a C3 gene in neural cell, such as a neural cell within a subject, e.g., a mammal, such as a human having a C3-associated neurodegenerative disease, e.g., Alzheimer's disease (AD), Amyotrophic Lateral Sclerosis (ALS), schizophrenia, Parkinson's disease (PD), and prion diseases, such as Creutzfeldt-Jakob disease (CJD).

The dsRNA includes an antisense strand having a region of complementarity which is complementary to at least a part of an mRNA formed in the expression of a C3 gene. The region of complementarity is about 30 nucleotides or less in length (e.g., about 30, 29, 28, 27, 26, 25, 24, 23, 22, 21, 20, 19, or 18 nucleotides or less in length). Upon contact with a cell, e.g., an ocular cell or a neural cell, expressing the C3 gene, the iRNA selectively inhibits the expression of the C3 gene (e.g., a human, a primate, a non-primate, or a bird C3 gene) by at least about 10% as assayed by, for example, a PCR or branched DNA (bDNA)-based method, or by a protein-based method, such as by immunofluorescence analysis, using, for example, Western Blotting or flowcytometric techniques.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a C3 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain preferred embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the dsRNA is about 15 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target C3 gene expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA. In certain embodiments, longer, extended overhangs are possible.

A dsRNA can be synthesized by standard methods known in the art as further discussed below, e.g., by use of an automated DNA synthesizer, such as are commercially available from, for example, Biosearch, Applied Biosystems, Inc. iRNA compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

An siRNA can be produced, e.g., in bulk, by a variety of methods. Exemplary methods include: organic synthesis and RNA cleavage, e.g., in vitro cleavage.

An siRNA can be made by separately synthesizing a single stranded RNA molecule, or each respective strand of a double-stranded RNA molecule, after which the component strands can then be annealed.

A large bioreactor, e.g., the OligoPilot II from Pharmacia Biotec AB (Uppsala Sweden), can be used to produce a large amount of a particular RNA strand for a given siRNA. The OligoPilotII reactor can efficiently couple a nucleotide using only a 1.5 molar excess of a phosphoramidite nucleotide. To make an RNA strand, ribonucleotides amidites are used. Standard cycles of monomer addition can be used to synthesize the 21 to 23 nucleotide strand for the siRNA. Typically, the two complementary strands are produced separately and then annealed, e.g., after release from the solid support and deprotection.

Organic synthesis can be used to produce a discrete siRNA species. The complementary of the species to a C3 gene can be precisely specified. For example, the species may be complementary to a region that includes a polymorphism, e.g., a single nucleotide polymorphism. Further the location of the polymorphism can be precisely defined. In some embodiments, the polymorphism is located in an internal region, e.g., at least 4, 5, 7, or 9 nucleotides from one or both of the termini.

In one embodiment, RNA generated is carefully purified to remove endsiRNA is cleaved in vitro into siRNAs, for example, using a Dicer or comparable RNAse III-based activity. For example, the dsiRNA can be incubated in an in vitro extract from *Drosophila* or using purified components, e.g., a purified RNAse or RISC complex (RNA-induced silencing complex). See, e.g., Ketting et al. *Genes Dev* 2001 Oct. 15; 15(20):2654-9 and Hammond *Science* 2001 Aug. 10; 293(5532):1146-50.

dsiRNA cleavage generally produces a plurality of siRNA species, each being a particular 21 to 23 nt fragment of a source dsiRNA molecule. For example, siRNAs that include sequences complementary to overlapping regions and adjacent regions of a source dsiRNA molecule may be present.

Regardless of the method of synthesis, the siRNA preparation can be prepared in a solution (e.g., an aqueous or organic solution) that is appropriate for formulation. For example, the siRNA preparation can be precipitated and redissolved in pure double-distilled water, and lyophilized. The dried siRNA can then be resuspended in a solution appropriate for the intended formulation process.

In one aspect, a dsRNA of the invention includes at least two nucleotide sequences, a sense sequence and an antisense sequence. The sense strand is selected from the group of sequences provided in the Tables herein, and the corresponding antisense strand of the sense strand is selected from the group of sequences in the Tables herein. In this aspect, one of the two sequences is complementary to the other of the two sequences, with one of the sequences being substantially complementary to a sequence of an mRNA generated in the expression of a C3 gene. As such, in this aspect, a dsRNA will include two oligonucleotides, where one oligonucleotide is described as the sense strand in the Tables herein, and the second oligonucleotide is described as the corresponding antisense strand of the sense strand in the Tables herein. In one embodiment, the substantially complementary sequences of the dsRNA are contained on separate oligonucleotides. In another embodiment, the substantially complementary sequences of the dsRNA are contained on a single oligonucleotide.

It will be understood that, although some of the sequences provided herein are described as modified or conjugated sequences, the RNA of the iRNA of the invention e.g., a dsRNA of the invention, may comprise any one of the sequences provides herein that is un-modified, un-conjugated, or modified or conjugated differently than described therein. One or more lipophilic ligands and/or one or more GalNAc ligands can be included in any of the positions of the RNAi agents provided in the instant application.

The skilled person is well aware that dsRNAs having a duplex structure of between about 20 and 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in the Tables herein, dsRNAs described herein can include at least one strand of a length of minimally 21 nucleotides. It can be reasonably expected that shorter duplexes having one of the sequences in the Tables herein minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences in the Tables herein, and differing in their ability to inhibit the expression of a C3 gene by not more than about 5, 10, 15, 20, 25, or 30% inhibition from a dsRNA comprising the full sequence, are contemplated to be within the scope of the present invention.

In addition, the RNAs provided in the Tables herein identify a site(s) in a C3 transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided in the Tables herein coupled to additional nucleotide sequences taken from the region contiguous to the selected sequence in a C3 gene.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of a C3 gene, generally does not contain any mismatch within the central 13 nucleotides. The methods described herein or methods known in the art can be used to determine whether an iRNA containing a mismatch to a target sequence is effective in inhibiting the expression of a C3 gene. Consideration of the efficacy of iRNAs with mismatches in inhibiting expression of a C3 gene is important, especially if the particular region of complementarity in a C3 gene is known to have polymorphic sequence variation within the population.

A. iRNAs of the Invention Comprising Modified Nucleotides

In one embodiment, the RNA of the RNAi agent of the disclosure e.g., a dsRNA, is un-modified, and does not comprise, e.g., chemical modifications or conjugations known in the art and described herein. In preferred embodiments, the RNA of an RNAi agent of the disclosure, e.g., a dsRNA, is chemically modified to enhance stability or other beneficial characteristics. In some embodiments, the double-stranded iRNA agent of the invention comprises at least one nucleic acid modification described herein. For example, at least one modification selected from the group consisting of modified internucleoside linkage, modified nucleobase, modified sugar, and any combinations thereof. Without limitations, such a modification can be present anywhere in the double-stranded iRNA agent of the invention. For example, the modification can be present in one of the RNA molecules. In certain embodiments of the disclosure, substantially all of the nucleotides of an RNAi agent of the disclosure are modified. In other embodiments of the disclosure, all of the nucleotides of an RNAi agent of the disclosure are modified. RNAi agents of the disclosure in which "substantially all of the nucleotides are modified" are largely but not wholly modified and can include not more than 5, 4, 3, 2, or 1 unmodified nucleotides. In still other embodiments of the disclosure, RNAi agents of the disclosure can include not more than 5, 4, 3, 2 or 1 modified nucleotides.

The nucleic acids featured in the disclosure can be synthesized or modified by methods well established in the art, such as those described in "Current protocols in nucleic acid chemistry," Beaucage, S. L. et al. (Edrs.), John Wiley &

Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of RNAi agents useful in the embodiments described herein include, but are not limited to, RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified RNAi agent will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, e.g., sodium salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in RNAi agents, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the RNAi agents of the disclosure are described in, for example, in Nielsen et al., Science, 1991, 254, 1497-1500.

Some embodiments featured in the disclosure include RNAs with phosphorothioate backbones and oligonucleosides with heteroatom backbones, and in particular $—CH_2—NH—CH_2—$, $—CH_2—N(CH_3)—O—CH_2—$[known as a methylene (methylimino) or MMI backbone], $—CH_2—O—N(CH_3)—CH_2—$, $—CH_2—N(CH_3)—N(CH_3)—CH_2—$ and $—N(CH_3)—CH_2—CH_2—$ of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506. The native phosphodiester backbone can be represented as O—P(O)(OH)—OCH2-.

Modified RNAs can also contain one or more substituted sugar moieties. The RNAi agents, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)\cdot_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of a RNAi agent, or a group for improving the pharmacodynamic properties of a RNAi agent, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_3)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$), 2'-O-hexadecyl, and 2'-fluoro (2'-F). Similar modifications can also be made at other positions on the RNA of a RNAi agent, particularly the 3' position of the sugar on the 3' terminal nucleotide or in 2'-5' linked dsRNAs and the 5' position of 5' terminal nucleotide. RNAi agents can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An RNAi agent of the disclosure can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., (1991) *Angewandte Chemie, International Edition,* 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the disclosure. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

An RNAi agent of the disclosure can also be modified to include one or more bicyclic sugar moities. A "bicyclic sugar" is a furanosyl ring modified by a ring formed by the bridging of two carbons, whether adjacent or non-adjacent atoms. A "bicyclic nucleoside" ("BNA") is a nucleoside having a sugar moiety comprising a ring formed by bridging comprising a bridge connecting two carbons, whether An RNAi agent of the disclosure can also be modified to include one or more bicyclic sugar moities. A "bicyclic sugar" is a furanosyl ring modified by a ring formed by the bridging of two carbons, whether adjacent or non-adjacent atoms. A "bicyclic nucleoside" ("BNA") is a nucleoside having a sugar adjacent or non-adjacent, two carbon atoms of the sugar ring, thereby forming a bicyclic ring system. In certain embodiments, the bridge connects the 4'-carbon and the 2'-carbon of the sugar ring, optionally, via the 2'-acyclic oxygen atom. Thus, in some embodiments an agent of the disclosure may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2-O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the disclosure include without limitation nucleosides comprising a bridge between the 4' and the 2' ribosyl ring atoms. In certain embodiments, the antisense polynucleotide agents of the disclosure include one or more bicyclic nucleosides comprising a 4' to 2' bridge.

A locked nucleoside can be represented by the structure (omitting stereochemistry),

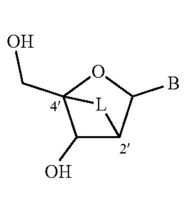

wherein B is a nucleobase or modified nucleobase and L is the linking group that joins the 2'-carbon to the 4'-carbon of the ribose ring.

Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a nitrogen protecting group (see, e.g., U.S. Pat. No. 7,427,672); 4'-CH2-C(H)(CH3)-2' (see, e.g., Chattopadhyaya et al., *J. Org. Chem.,* 2009, 74, 118-134); and 4'-CH2-C(═CH2)-2' (and analogs thereof; see, e.g., U.S. Pat. No. 8,278,426). The entire contents of each of the foregoing are hereby incorporated herein by reference.

Additional representative U.S. Patents and U.S. Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

An RNAi agent of the disclosure can also be modified to include one or more constrained ethyl nucleotides. As used herein, a "constrained ethyl nucleotide" or "cEt" is a locked nucleic acid comprising a bicyclic sugar moiety comprising a 4'-CH(CH3)-O-2' bridge (i.e., L in the preceding structure). In one embodiment, a constrained ethyl nucleotide is in the S conformation referred to herein as "S-cEt."

An RNAi agent of the disclosure may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US 2013/0190383; and WO 2013/036868, the entire contents of each of which are hereby incorporated herein by reference.

In some embodiments, a RNAi agent of the disclosure comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.,* 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3'-phosphate, inverted base dT(idT) and others. Disclosure of this modification can be found in WO 2011/005861.

Other modifications of a RNAi agent of the disclosure include a 5' phosphate or 5' phosphate mimic, e.g., a 5'-terminal phosphate or phosphate mimic on the antisense strand of a RNAi agent. Suitable phosphate mimics are disclosed in, for example US 2012/0157511, the entire contents of which are incorporated herein by reference.

In some embodiments, the double-stranded iRNA agent further comprises a phosphate or phosphate mimic at the 5'-end of the antisense strand. In one embodiment, the phosphate mimic is a 5'-vinyl phosphonate (VP).

When the phosphate mimic is a 5'-vinyl phosphonate (VP), the 5'-terminal nucleotide can have the following structure,

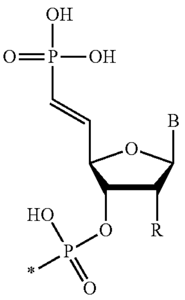

wherein * indicates the location of the bond to 5'-position of the adjacent nucleotide;

R is hydrogen, hydroxy, methoxy, fluoro, or another 2'-modification described herein (e.g., hydroxy or methoxy); and B is a nucleobase or a modified nucleobase, optionally where B is adenine, guanine, cytosine, thymine or uracil.

In some embodiments, the 5'-end of the antisense strand of the double-stranded iRNA agent does not contain a 5'-vinyl phosphonate (VP).

B. Modified iRNAs Comprising Motifs of the Invention

In certain aspects of the disclosure, the double-stranded RNAi agents of the disclosure include agents with chemical modifications as disclosed, for example, in WO 2013/075035, the entire contents of which are incorporated herein by reference. As shown herein and in WO 2013/075035, a superior result may be obtained by introducing one or more motifs of three identical modifications on three consecutive nucleotides may be introduced into a sense strand or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense or antisense strand. The RNAi agent may be optionally conjugated with a lipophilic ligand, e.g., a C16 ligand, for instance on the sense strand. The RNAi agent may be optionally modified with a (S)-glycol nucleic acid (GNA) modification, for instance on one or more residues of the antisense strand.

Accordingly, the disclosure provides double stranded RNAi agents capable of inhibiting the expression of a target gene (i.e., a C3 gene) in vivo. The RNAi agent comprises a sense strand and an antisense strand. Each strand of the RNAi agent may be 15-30 nucleotides in length. For example, each strand may be 16-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length. In certain embodiments, each strand is 19-23 nucleotides in length.

The sense strand and antisense strand typically form a duplex double stranded RNA ("dsRNA"), also referred to herein as an "RNAi agent." The duplex region of an RNAi agent may be 15-30 nucleotide pairs in length. For example, the duplex region can be 16-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length. In preferred embodiments, the duplex region is 19-21 nucleotide pairs in length.

In one embodiment, the RNAi agent may contain one or more overhang regions or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In preferred embodiments, the nucleotide overhang region is 2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-O-methyl, thymidine (T), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3-terminal end of the sense strand or, alternatively, at the 3-terminal end of the antisense strand. The RNAi may also have a blunt end, located at the 5'-end of the antisense strand (i.e., the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double blunt-ended of 19 nucleotides in length, wherein the sense strand contains at least one motif of three 2'-F modifications on three consecutive nucleotides at positions 7, 8, and 9 from the 5'end. The antisense strand contains at least one motif of three 2'-O-methyl modifications on three consecutive nucleotides at positions 11, 12, and 13 from the 5'end.

In another embodiment, the RNAi agent is a double blunt-ended of 20 nucleotides in length, wherein the sense strand contains at least one motif of three 2'-F modifications on three consecutive nucleotides at positions 8, 9, and 10 from the 5'end. The antisense strand contains at least one motif of three 2'-O-methyl modifications on three consecutive nucleotides at positions 11, 12, and 13 from the 5'end.

In yet another embodiment, the RNAi agent is a double blunt-ended of 21 nucleotides in length, wherein the sense strand contains at least one motif of three 2'-F modifications on three consecutive nucleotides at positions 9, 10, and 11 from the 5'end. The antisense strand contains at least one motif of three 2'-O-methyl modifications on three consecutive nucleotides at positions 11, 12, and 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. In some embodiments, the 2 nucleotide overhang is at the 3'-end of the antisense strand. When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (e.g., a lipophilic ligand, optionally a C16ligand).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand.

For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two, or three nucleotides in the duplex region.

In one embodiment, the RNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxythymidine (dT). In another embodiment, the nucleotide at the 3'-end of the antisense strand is deoxythymidine (dT). In one embodiment, there is a short sequence of deoxythymidine nucleotides, for example, two dT nucleotides on the 3'-end of the sense or antisense strand.

In one embodiment, the sense strand sequence may be represented by formula (I):

$$5'\ n_p\text{-}N_a\text{—}(X\ X\ X)_i\text{—}N_b\text{—}Y\ Y\ Y\text{—}N_b\text{—}(Z\ Z\ Z)_j\text{—}N_a\text{-}n_q\ 3' \qquad (I)$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein Nb and Y do not have the same modification; and

XXX, YYY and ZZZ each independently represent one motif of three identical modifications on three consecutive nucleotides. In some embodiments, YYY is all 2'-F modified nucleotides.

In one embodiment, the $N_a$ or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the $1^{st}$ nucleotide, from the 5'-end; or optionally, the count starting at the $1^{st}$ paired nucleotide within the duplex region, from the 5'-end.

In one embodiment, i is 1 and j is 0, or i is 0 and j is 1, or both i and j are 1. The sense strand can therefore be represented by the following formulas:

$$5'\ n_p\text{-}N_a\text{—}YYY\text{—}N_b\text{—}ZZZ\text{—}N_a\text{-}n_q\ 3' \qquad (Ib);$$

$$5'\ n_p\text{-}N_a\text{—}XXX\text{—}N_b\text{—}YYY\text{—}N_a\text{-}n_q\ 3' \qquad (Ic);\ or$$

$$5'\ n_p\text{-}N_a\text{—}XXX\text{—}N_b\text{—}YYY\text{—}N_b\text{—}ZZZ\text{—}N_a\text{-}n_q\ 3' \qquad (Id).$$

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. In some embodiments, $N_b$ is 0, 1, 2, 3, 4, 5 or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$$5'\ n_p\text{-}N_a\text{—}YYY\text{—}N_a\text{-}n_q\ 3' \qquad (Ia).$$

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

$$5'\ n_q'\text{-}N_a'\text{—}(Z'Z'Z')_k\text{—}N_b'\text{—}Y'Y'Y'\text{—}N_b'\text{—}(X'X'X')_l\text{—}N'_a\text{-}n_p'\ 3' \qquad (II)$$

wherein:

k and 1 are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y' and Z'Z'Z' each independently represent one motif of three identical modifications on three consecutive nucleotides.

In one embodiment, the $N_a'$ or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the $1^{st}$ nucleotide, from the 5'-end; or optionally, the count starting at the $1^{st}$ paired nucleotide within the duplex region, from the 5'-end. In some embodiments, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

$$5'\ n_q'\text{-}N_a'\text{—}Z'Z'Z'\text{—}N_b'\text{—}Y'Y'Y'\text{—}N_a'\text{-}n_{p'}\ 3' \qquad (IIb);$$

$$5'\ n_q'\text{-}N_a'\text{—}Y'Y'Y'\text{—}N_b'\text{—}X'X'X'\text{-}n_p'\ 3' \qquad (IIc);\ or$$

$$5'\ n_q'\text{-}N_a'\text{—}Z'Z'Z'\text{—}N_b'\text{—}Y'Y'Y'\text{—}N_b'\text{—}X'X'X'\text{—}N_a'\text{-}n_{p'}\ 3' \qquad (IId).$$

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. In some embodiments, $N_b$ is 0, 1, 2, 3, 4, 5 or 6.

In other embodiments, k is 0 and l is 0 and the antisense strand may be represented by the formula:

$$5'\ n_{p'}\text{-}N_{a'}\text{—Y'Y'Y'—}N_{a'}\text{-}n_{q'}\ 3' \qquad \text{(Ia).}$$

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, glycol nucleic acid (GNA), hexitol nucleic acid (HNA), 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1st nucleotide from the 5'-end, or optionally, the count starting at the 1st paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1st nucleotide from the 5'-end, or optionally, the count starting at the 1st paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the disclosure may comprise a sense strand and an antisense strand, each strand having 14 to 30 nucleotides, the RNAi duplex represented by formula (III):

$$\text{sense: } 5'\ n_p\text{-}N_a\text{—(X X X)}_i\text{—}N_b\text{—Y Y Y—}N_b\text{—(Z Z Z)}_j\text{-}N_a\text{-}n_q\ 3'$$

$$\text{antisense: } 3'\ n_p'\text{-}N_a'\text{—(X'X'X')}_k\text{—}N_b'\text{—Y'Y'Y'—}N_b'\text{—(Z'Z'Z')}_l N_a'\text{-}n_q'\ 5' \qquad \text{(III)}$$

wherein:

i, j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;

wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

$$5'\ n_p\text{-}N_a\text{—Y Y Y—}N_a\text{-}n_q\ 3'$$

$$3'\ n_p'\text{-}N_a'\text{—Y'Y'Y'—}N_a' n_q'\ 5' \qquad \text{(IIIa)}$$

$$5'\ n_p\text{-}N_a\text{—Y Y Y—}N_b\text{—Z Z Z—}N_a\text{-}n_q\ 3'$$

$$3'\ n_p'\text{-}N_a'\text{—Y'Y'Y'—}N_b'\text{—Z'Z'Z'—}N_a' n_q'\ 5' \qquad \text{(IIIb)}$$

$$5'\ n_p\text{-}N_a\text{—X X X—}N_b\text{—Y Y Y—}N_a\text{-}n_q\ 3'$$

$$3'\ n_p'\text{-}N_a'\text{—X'X'X'—}N_b'\text{—Y'Y'Y'—}N_a'\text{-}n_q'\ 5' \qquad \text{(IIIc)}$$

$$5'\ n_p\text{-}N_a\text{—X X X—}N_b\text{—Y Y Y—}N_b\text{—Z Z Z—}N_a\text{-}n_q\ 3'$$

$$3'\ n_p'\text{—}N_a'\text{—X'X'X'—}N_b'\text{—Y'Y'Y'—}N_b'\text{—Z'Z'Z'—}N_a\text{-}n_q'\ 5' \qquad \text{(IIId)}$$

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b'$ independently represents an oligonucleotide sequence comprising 0-10, 0-7, 0-10, 0-7, 0-5, 0-4, 0-2 or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$ and $N_b'$ independently comprises modifications of alternating pattern.

In one embodiment, when the RNAi agent is represented by formula (IIId), the Na modifications are 2'-O-methyl or 2'-fluoro modifications. In another embodiment, when the RNAi agent is represented by formula (IIId), the $N_a$ modifications are 2'-O-methyl or 2'-fluoro modifications and $n_p$'>0 and at least one $n_p$' is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p$'>0 and at least one $n_p$' is linked to a neighboring nucleotide via phosphorothioate linkage, and the sense strand is conjugated to one or more C16 (or related) moieties attached through a bivalent or trivalent branched linker (described below). In another embodiment, when the RNAi agent is represented by formula (IIId), the $N_a$ modifications are 2'-O-methyl or 2'-fluoro modifications, $n_p$'>0 and at least one $n_p$' is linked to a neighboring nucleotide via phosphorothioate linkage, the sense strand comprises at least one phosphorothioate linkage, and the sense strand is conjugated to one or more lipophilic, e.g., C16 (or related) moieties, optionally attached through a bivalent or trivalent branched linker.

In one embodiment, when the RNAi agent is represented by formula (IIIa), the $N_a$ modifications are 2'-O-methyl or 2'-fluoro modifications, $n_p$'>0 and at least one $n_p$' is linked to a neighboring nucleotide via phosphorothioate linkage, the sense strand comprises at least one phosphorothioate linkage, and the sense strand is conjugated to one or more lipophilic, e.g., C16 (or related) moieties attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the disclosure. Such publications include WO2007/091269, WO2010/141511, WO2007/117686, WO2009/014887, and WO2011/031520; and U.S. Pat. No. 7,858,769, the entire contents of each of which are hereby incorporated herein by reference.

In certain embodiments, the compositions and methods of the disclosure include a vinyl phosphonate (VP) modification of an RNAi agent as described herein. In exemplary embodiments, a 5'-vinyl phosphonate modified nucleotide of the disclosure has the structure:

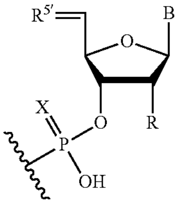

wherein X is O or S;

R is hydrogen, hydroxy, fluoro, or $C_{1-20}$alkoxy (e.g., methoxy or n-hexadecyloxy);

$R^{5'}$ is $=C(H)-P(O)(OH)_2$ and the double bond between the C5' carbon and $R^{5'}$ is in the E or Z orientation (e.g., E orientation); and B is a nucleobase or a modified nucleobase, optionally where B is adenine, guanine, cytosine, thymine, or uracil.

A vinyl phosphonate of the instant disclosure may be attached to either the antisense or the sense strand of a dsRNA of the disclosure. In certain preferred embodiments, a vinyl phosphonate of the instant disclosure is attached to the antisense strand of a dsRNA, optionally at the 5' end of the antisense strand of the dsRNA.

Vinyl phosphate modifications are also contemplated for the compositions and methods of the instant disclosure. An exemplary vinyl phosphate structure includes the preceding structure, where R5' is ═C(H)—OP(O)(OH)2 and the double bond between the C5' carbon and R5' is in the E or Z orientation (e.g., E orientation).

E. Thermally Destabilizing Modifications

In certain embodiments, a dsRNA molecule can be optimized for RNA interference by incorporating thermally destabilizing modifications in the seed region of the antisense strand. As used herein "seed region" means at positions 2-9 of the 5'-end of the referenced strand. For example, thermally destabilizing modifications can be incorporated in the seed region of the antisense strand to reduce or inhibit off-target gene silencing.

The term "thermally destabilizing modification(s)" includes modification(s) that would result with a dsRNA with a lower overall melting temperature (Tm) than the Tm of the dsRNA without having such modification(s). For example, the thermally destabilizing modification(s) can decrease the Tm of the dsRNA by 1-4° C., such as one, two, three or four degrees Celcius. And, the term "thermally destabilizing nucleotide" refers to a nucleotide containing one or more thermally destabilizing modifications.

It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, or positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. In some embodiments, the thermally destabilizing modification of the duplex is located at position 2, 3, 4, 5 or 9 from the 5'-end of the antisense strand.

The thermally destabilizing modifications can include, but are not limited to, abasic modification; mismatch with the opposing nucleotide in the opposing strand; and sugar modification such as 2'-deoxy modification or acyclic nucleotide, e.g., unlocked nucleic acids (UNA) or glycol nucleic acid (GNA).

Exemplified abasic modifications include but are not limited to the following:

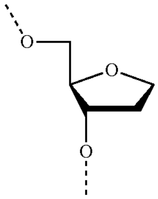
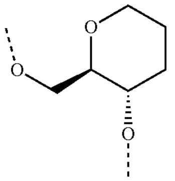
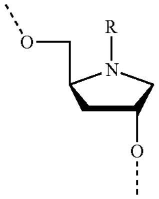
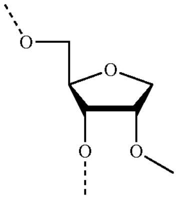
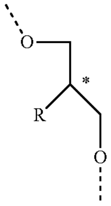
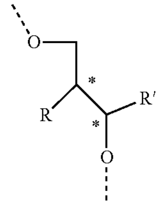
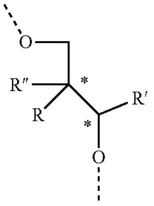

Wherein R=H, Me, Et or OMe; R'=H, Me, Et or OMe; R"=H, Me, Et or OMe

Mod2

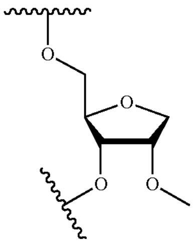

(2'-OMe Abasic Spacer)

Mod3

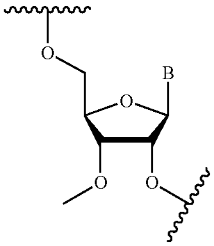

(3'-OMe)

-continued

Mod4

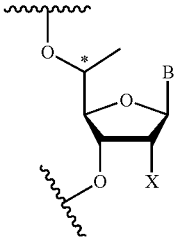

(5'-Me)
X = OMe, F

Mod5

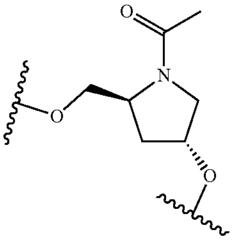

(Hyp-spacer)

wherein B is a modified or unmodified nucleobase.

Exemplified sugar modifications include, but are not limited to the following:

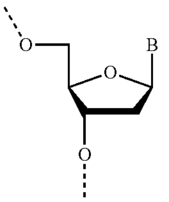

2'-deoxy

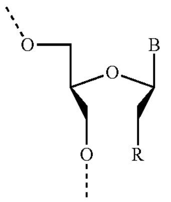

unlocked nucleic acid
R = H, OH, O-alkyl

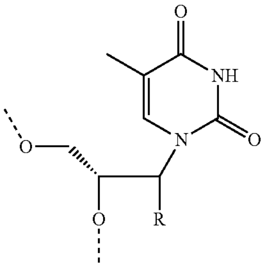

glycol nucleic acid
R = H, OH, O-alkyl

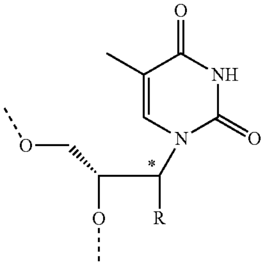

glycol nucleic acid
R = H, OH, O-alkyl

-continued

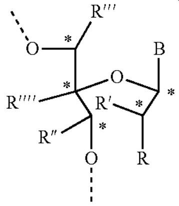

unlocked nucleic acid
R = H, OH, $CH_3$, $CH_2CH_3$, O-alkyl, $NH_2$, NHMe, $NMe_2$
R' = H, OH, $CH_3$, $CH_2CH_3$, O-alkyl, $NH_2$, NHMe, $NMe_2$
R'' = H, OH, $CH_3$, $CH_2CH_3$, O-alkyl, $NH_2$, NHMe, $NMe_2$
R''' = H, OH, $CH_3$, $CH_2CH_3$, O-alkyl, $NH_2$, NHMe, $NMe_2$
R'''' = H, OH, $CH_3$, $CH_2CH_3$, O-alkyl, $NH_2$, NHMe, $NMe_2$

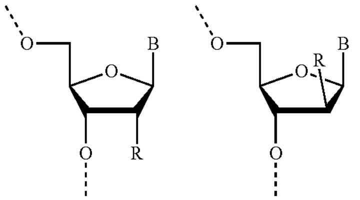

R = H, methyl, ethyl wherein B is a modified or unmodified nucleobase.

In some embodiments the thermally destabilizing modification of the duplex is selected from the group consisting of:

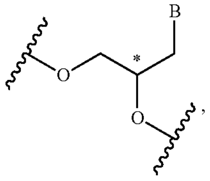
,
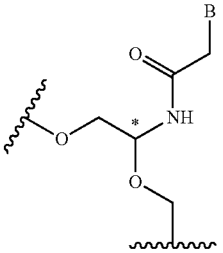
,
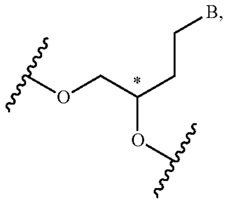
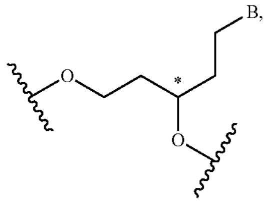
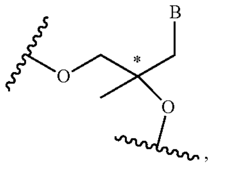
and
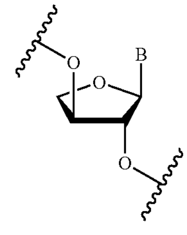

wherein B is a modified or unmodified nucleobase and the asterisk on each structure represents either R, S or racemic.

The term "acyclic nucleotide" refers to any nucleotide having an acyclic ribose sugar, for example, where any of bonds between the ribose carbons (e.g., C1'-C2', C2'-C3', C3'-C4', C4'-O4', or C1'-O4') is absent or at least one of ribose carbons or oxygen (e.g., C1', C2', C3', C4', or O4') are independently or in combination absent from the nucleotide. In some embodiments, acyclic nucleotide

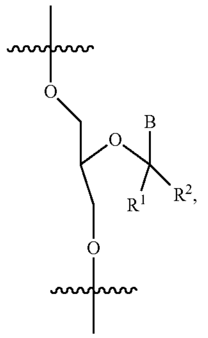
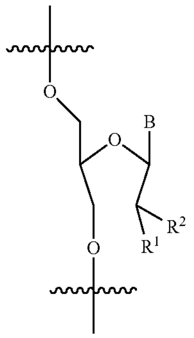
,
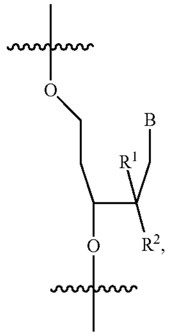
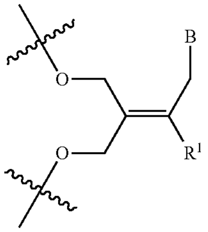
or
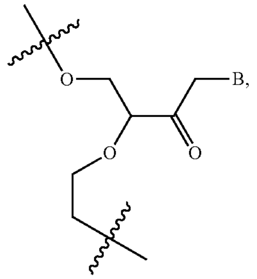

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar). The term "UNA" refers to unlocked acyclic nucleic acid, wherein any of the bonds of the sugar has been removed, forming an unlocked "sugar" residue. In one example, UNA also encompasses monomers with bonds between C1'-C4' being removed (i.e. the covalent carbon-oxygen-carbon bond between the C1' and C4' carbons). In another example, the C2'-C3' bond (i.e. the covalent carbon-carbon bond between the C2' and C3' carbons) of the sugar is removed (see Mikhailov et. al., Tetrahedron Letters, 26 (17): 2059 (1985); and Fluiter et al., Mol. Biosyst., 10: 1039 (2009), which are hereby incorporated by reference in their entirety). The acyclic derivative provides greater backbone flexibility without affecting the Watson-Crick pairings. The acyclic nucleotide can be linked via 2'-5' or 3'-5' linkage.

The term 'GNA' refers to glycol nucleic acid which is a polymer similar to DNA or RNA but differing in the composition of its "backbone" in that is composed of repeating glycerol units linked by phosphodiester bonds:

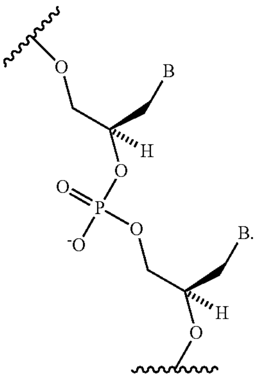

(R)-GNA

The thermally destabilizing modification of the duplex can be mismatches (i.e., noncomplementary base pairs) between the thermally destabilizing nucleotide and the opposing nucleotide in the opposite strand within the dsRNA duplex. Exemplary mismatch base pairs include G:G, G:A, G:U, G:T, A:A, A:C, C:C, C:U, C:T, U:U, T:T, U:T, or a combination thereof. Other mismatch base pairings known in the art are also amenable to the present invention. A mismatch can occur between nucleotides that are either naturally occurring nucleotides or modified nucleotides, i.e., the mismatch base pairing can occur between the nucleobases from respective nucleotides independent of the modifications on the ribose sugars of the nucleotides. In certain embodiments, the dsRNA molecule contains at least one nucleobase in the mismatch pairing that is a 2'-deoxy nucleobase; e.g., the 2'-deoxy nucleobase is in the sense strand.

In some embodiments, the thermally destabilizing modification of the duplex in the seed region of the antisense strand includes nucleotides with impaired Watson-Crick hydrogen-bonding W-C H-bonding to the complementary base on the target mRNA, such as modified nucleobases:

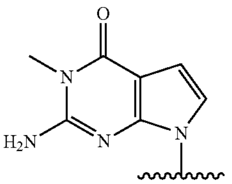 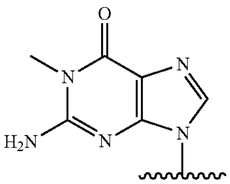

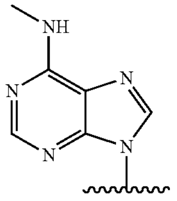 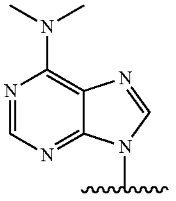

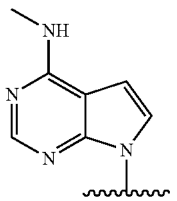 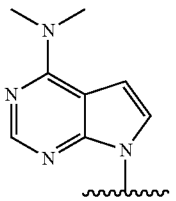 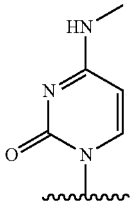

-continued

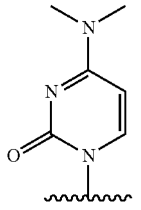 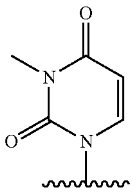 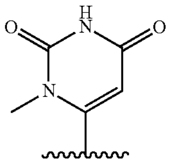

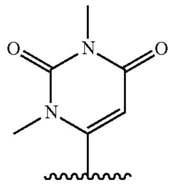 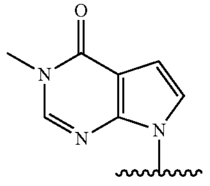

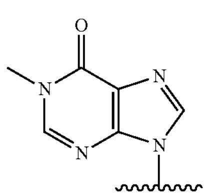 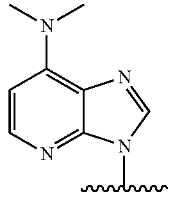

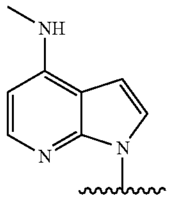 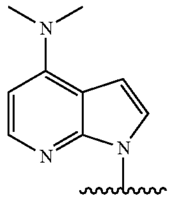 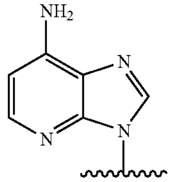

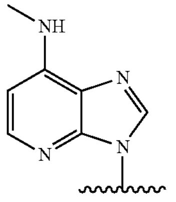 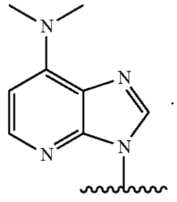.

More examples of abasic nucleotide, acyclic nucleotide modifications (including UNA and GNA), and mismatch modifications have been described in detail in WO 2011/133876, which is herein incorporated by reference in its entirety.

The thermally destabilizing modifications may also include universal base with reduced or abolished capability to form hydrogen bonds with the opposing bases, and phosphate modifications.

In some embodiments, the thermally destabilizing modification of the duplex includes nucleotides with non-canonical bases such as, but not limited to, nucleobase modifications with impaired or completely abolished capability to form hydrogen bonds with bases in the opposite strand. These nucleobase modifications have been evaluated for destabilization of the central region of the dsRNA duplex as described in WO 2010/0011895, which is herein incorporated by reference in its entirety. Exemplary nucleobase modifications are:

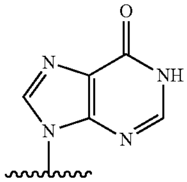

inosine

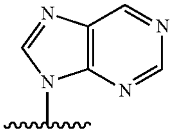

nebularine

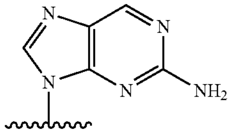

2-aminopurine

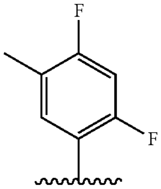

2,4-difluorotoluene

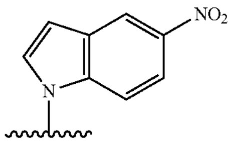

5-nitroindole

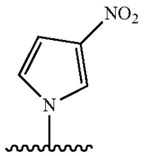

3-nitropyrrole

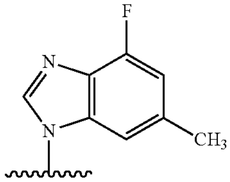

4-Fluoro-6-methylbenzimidazole

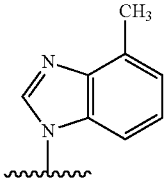

4-Methylbenzimidazole

In some embodiments, the thermally destabilizing modification of the duplex in the seed region of the antisense strand includes one or more α-nucleotide complementary to the base on the target mRNA, such as:

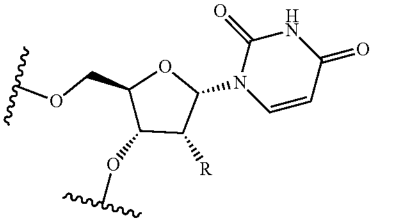

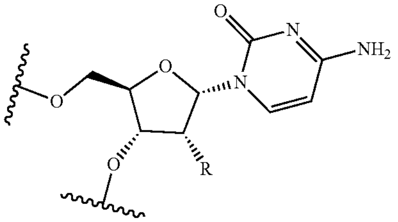

-continued

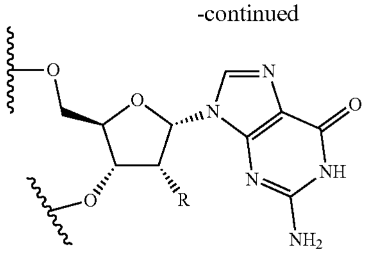

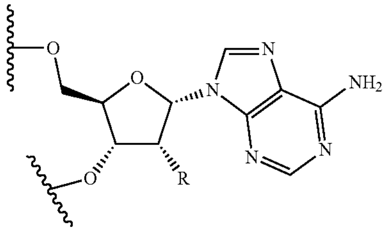

wherein R is H, OH, $OCH_3$, F, $NH_2$, NHMe, $NMe_2$ or O-alkyl.

Exemplary phosphate modifications known to decrease the thermal stability of dsRNA duplexes compared to natural phosphodiester linkages are:

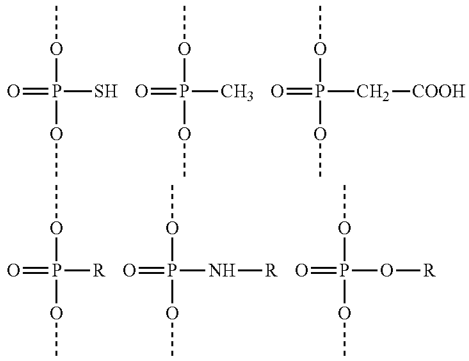

R = alkyl

The alkyl for the R group can be a $C_1$-$C_6$alkyl. Specific alkyls for the R group include, but are not limited to methyl, ethyl, propyl, isopropyl, butyl, pentyl and hexyl.

As the skilled artisan will recognize, in view of the functional role of nucleobases is defining specificity of a RNAi agent of the disclosure, while nucleobase modifications can be performed in the various manners as described herein, e.g., to introduce destabilizing modifications into a RNAi agent of the disclosure, e.g., for purpose of enhancing on-target effect relative to off-target effect, the range of modifications available and, in general, present upon RNAi agents of the disclosure tends to be much greater for non-nucleobase modifications, e.g., modifications to sugar groups or phosphate backbones of polyribonucleotides. Such modifications are described in greater detail in other sections of the instant disclosure and are expressly contemplated for RNAi agents of the disclosure, either possessing native nucleobases or modified nucleobases as described above or elsewhere herein.

In addition to the antisense strand comprising a thermally destabilizing modification, the dsRNA can also comprise one or more stabilizing modifications. For example, the dsRNA can comprise at least two (e.g., two, three, four, five, six, seven, eight, nine, ten or more) stabilizing modifications. Without limitations, the stabilizing modifications all can be present in one strand. In some embodiments, both the sense and the antisense strands comprise at least two stabilizing modifications. The stabilizing modification can occur on any nucleotide of the sense strand or antisense strand. For instance, the stabilizing modification can occur on every nucleotide on the sense strand or antisense strand; each stabilizing modification can occur in an alternating pattern on the sense strand or antisense strand; or the sense strand or antisense strand comprises both stabilizing modification in an alternating pattern. The alternating pattern of the stabilizing modifications on the sense strand may be the same or different from the antisense strand, and the alternating pattern of the stabilizing modifications on the sense strand can have a shift relative to the alternating pattern of the stabilizing modifications on the antisense strand.

In some embodiments, the antisense strand comprises at least two (e.g., two, three, four, five, six, seven, eight, nine, ten or more) stabilizing modifications. Without limitations, a stabilizing modification in the antisense strand can be present at any positions. In some embodiments, the antisense comprises stabilizing modifications at positions 2, 6, 8, 9, 14, and 16 from the 5'-end. In some other embodiments, the antisense comprises stabilizing modifications at positions 2, 6, 14, and 16 from the 5'-end. In still some other embodiments, the antisense comprises stabilizing modifications at positions 2, 14, and 16 from the 5'-end.

In some embodiments, the antisense strand comprises at least one stabilizing modification adjacent to the destabilizing modification. For example, the stabilizing modification can be the nucleotide at the 5'-end or the 3'-end of the destabilizing modification, i.e., at position −1 or +1 from the position of the destabilizing modification. In some embodiments, the antisense strand comprises a stabilizing modification at each of the 5'-end and the 3'-end of the destabilizing modification, i.e., positions −1 and +1 from the position of the destabilizing modification.

In some embodiments, the antisense strand comprises at least two stabilizing modifications at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) stabilizing modifications. Without limitations, a stabilizing modification in the sense strand can be present at any positions. In some embodiments, the sense strand comprises stabilizing modifications at positions 7, 10, and 11 from the 5'-end. In some other embodiments, the sense strand comprises stabilizing modifications at positions 7, 9, 10, and 11 from the 5'-end. In some embodiments, the sense strand comprises stabilizing modifications at positions opposite or complimentary to positions 11, 12, and 15 of the antisense strand, counting from the 5'-end of the antisense strand. In some other embodiments, the sense strand comprises stabilizing modifications at positions opposite or complimentary to positions 11, 12, 13, and 15 of the antisense strand, counting from the 5'-end of the antisense strand. In some embodiments, the sense strand comprises a block of two, three, or four stabilizing modifications.

In some embodiments, the sense strand does not comprise a stabilizing modification in position opposite or complimentary to the thermally destabilizing modification of the duplex in the antisense strand.

Exemplary thermally stabilizing modifications include, but are not limited to, 2'-fluoro modifications. Other thermally stabilizing modifications include, but are not limited to, LNA.

In some embodiments, the dsRNA of the disclosure comprises at least four (e.g., four, five, six, seven, eight, nine, ten, or more) 2'-fluoro nucleotides. Without limitations, the 2'-fluoro nucleotides all can be present in one strand. In some embodiments, both the sense and the antisense strands comprise at least two 2'-fluoro nucleotides. The 2'-fluoro modification can occur on any nucleotide of the sense strand or antisense strand. For instance, the 2'-fluoro modification can occur on every nucleotide on the sense strand or antisense strand; each 2'-fluoro modification can occur in an alternating pattern on the sense strand or antisense strand; or the sense strand or antisense strand comprises both 2'-fluoro modifications in an alternating pattern. The alternating pattern of the 2'-fluoro modifications on the sense strand may be the same or different from the antisense strand, and the alternating pattern of the 2'-fluoro modifications on the sense strand can have a shift relative to the alternating pattern of the 2'-fluoro modifications on the antisense strand.

In some embodiments, the antisense strand comprises at least two (e.g., two, three, four, five, six, seven, eight, nine, ten, or more) 2'-fluoro nucleotides. Without limitations, a 2'-fluoro modification in the antisense strand can be present at any positions. In some embodiments, the antisense comprises 2'-fluoro nucleotides at positions 2, 6, 8, 9, 14, and 16 from the 5'-end. In some other embodiments, the antisense comprises 2'-fluoro nucleotides at positions 2, 6, 14, and 16 from the 5'-end. In still some other embodiments, the antisense comprises 2'-fluoro nucleotides at positions 2, 14, and 16 from the 5'-end.

In some embodiments, the antisense strand comprises at least one 2'-fluoro nucleotide adjacent to the destabilizing modification. For example, the 2'-fluoro nucleotide can be the nucleotide at the 5'-end or the 3'-end of the destabilizing modification, i.e., at position −1 or +1 from the position of the destabilizing modification. In some embodiments, the antisense strand comprises a 2'-fluoro nucleotide at each of the 5'-end and the 3'-end of the destabilizing modification, i.e., positions −1 and +1 from the position of the destabilizing modification.

In some embodiments, the antisense strand comprises at least two 2'-fluoro nucleotides at the 3'-end of the destabilizing modification, i.e., at positions +1 and +2 from the position of the destabilizing modification.

In some embodiments, the sense strand comprises at least two (e.g., two, three, four, five, six, seven, eight, nine, ten, or more) 2'-fluoro nucleotides. Without limitations, a 2'-fluoro modification in the sense strand can be present at any positions. In some embodiments, the antisense comprises 2'-fluoro nucleotides at positions 7, 10, and 11 from the 5'-end. In some other embodiments, the sense strand comprises 2'-fluoro nucleotides at positions 7, 9, 10, and 11 from the 5'-end. In some embodiments, the sense strand comprises 2'-fluoro nucleotides at positions opposite or complimentary to positions 11, 12, and 15 of the antisense strand, counting from the 5'-end of the antisense strand. In some other embodiments, the sense strand comprises 2'-fluoro nucleotides at positions opposite or complimentary to positions 11, 12, 13, and 15 of the antisense strand, counting from the 5'-end of the antisense strand. In some embodiments, the sense strand comprises a block of two, three or four 2'-fluoro nucleotides.

In some embodiments, the sense strand does not comprise a 2'-fluoro nucleotide in position opposite or complimentary to the thermally destabilizing modification of the duplex in the antisense strand.

In some embodiments, the dsRNA molecule of the disclosure comprises a 21 nucleotides (nt) sense strand and a 23 nucleotides (nt) antisense, wherein the antisense strand contains at least one thermally destabilizing nucleotide, where the at least one thermally destabilizing nucleotide occurs in the seed region of the antisense strand (i.e., at position 2-9 of the 5'-end of the antisense strand), wherein one end of the dsRNA is blunt, while the other end is comprises a two nucleotide overhang, and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; (vi) the dsRNA comprises at least four 2'-fluoro modifications; and (vii) the dsRNA comprises a blunt end at 5'-end of the antisense strand. In one embodiment, the two nucleotide overhang is at the 3'-end of the antisense.

In some embodiments, the dsRNA molecule of the disclosure comprising a sense and antisense strands, wherein: the sense strand is 25-30 nucleotide residues in length, wherein starting from the 5' terminal nucleotide (position 1), positions 1 to 23 of said sense strand comprise at least 8 ribonucleotides; antisense strand is 36-66 nucleotide residues in length and, starting from the 3' terminal nucleotide, at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when said double stranded nucleic acid is introduced into a mammalian cell; and wherein the antisense strand contains at least one thermally destabilizing nucleotide, where at least one thermally destabilizing nucleotide is in the seed region of the antisense strand (i.e. at position 2-9 of the 5'-end of the antisense strand). For example, the thermally destabilizing nucleotide occurs between positions opposite or complimentary to positions 14-17 of the 5'-end of the sense strand, and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA comprises a duplex region of 12-30 nucleotide pairs in length.

In some embodiments, the dsRNA molecule of the disclosure comprises a sense and antisense strands, wherein said dsRNA molecule comprises a sense strand having a length which is at least 25 and at most 29 nucleotides and an antisense strand having a length which is at most 30 nucleotides with the sense strand comprises a modified nucleotide that is susceptible to enzymatic degradation at position 11 from the 5'end, wherein the 3' end of said sense strand and the 5' end of said antisense strand form a blunt end and said antisense strand is 1-4 nucleotides longer at its 3' end than the sense strand, wherein the duplex region which is at least 25 nucleotides in length, and said antisense strand is sufficiently complementary to a target mRNA along at least 19 nt of said antisense strand length to reduce target gene expression when said dsRNA molecule is introduced into a mammalian cell, and wherein dicer cleavage of said dsRNA preferentially results in an siRNA comprising said 3' end of said antisense strand, thereby reducing expression of the target gene in the mammal, wherein the antisense strand contains at least one thermally destabilizing nucleotide, where the at least one thermally destabilizing nucleotide is in the seed region of the antisense strand (i.e. at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA has a duplex region of 12-29 nucleotide pairs in length.

In some embodiments, every nucleotide in the sense strand and antisense strand of the dsRNA molecule may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2' hydroxyl on the ribose sugar; wholesale replacement of the phosphate moiety with “dephospho” linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases, the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of an RNA. E.g., a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. E.g., it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, glycol nucleic acid (GNA), hexitol nucleic acid (HNA), 2'-methoxyethyl, 2'-O-methyl, 2'-O-allyl, 2'-C-allyl, 2'-deoxy, or 2'-fluoro. The strands can contain more than one modification. In some embodiments, each residue of the sense strand and antisense strand is independently modified with 2'-O-methyl or 2'-fluoro. It is to be understood that these modifications are in addition to the at least one thermally destabilizing modification of the duplex present in the antisense strand.

At least two different modifications are typically present on the sense strand and antisense strand. Those two modifications may be the 2'-deoxy, 2'-O-methyl or 2'-fluoro modifications, acyclic nucleotides or others. In some embodiments, the sense strand and antisense strand each comprises two differently modified nucleotides selected from 2'-O-methyl or 2'-deoxy. In some embodiments, each residue of the sense strand and antisense strand is independently modified with 2'-O-methyl nucleotide, 2'-deoxy nucleotide, 2'-deoxy-2'-fluoro nucleotide, 2'-O—N-methylacetamido (2'-O—NMA, 2'O—CH2C(O)N(Me)H) nucleotide, a 2'-O-dimethylaminoethoxyethyl (2'-O-DMAEOE) nucleotide, 2'-O-aminopropyl (2'-O-AP) nucleotide, or 2'-ara-F nucleotide. Again, it is to be understood that these modifications are in addition to the at least one thermally destabilizing modification of the duplex present in the antisense strand.

In some embodiments, the dsRNA molecule of the disclosure comprises modifications of an alternating pattern. The term "alternating motif" or "alternative pattern" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNA molecule of the disclosure comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5' of the strand within the duplex region. As another example, the alternating motif in the sense strand may start with "AABBAABB" from 5'-3' of the strand and the alternating motif in the antisense strand may start with "BBAABBAA" from 3'-5' of the strand within the duplex region, so that there is a complete or partial shift of the modification patterns between the sense strand and the antisense strand.

The dsRNA molecule of the disclosure may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA molecule comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. In some embodiments, these terminal three nucleotides may be at the 3'-end of the antisense strand.

In some embodiments, the sense strand of the dsRNA molecule comprises 1-10 blocks of two to ten phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of two phosphorothioate or methylphosphonate internucleotide linkages separated by 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of three phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of four phosphorothioate or methylphosphonate internucleotide linkages separated by 1, 2, 3, 4, 5, 6, 7, 8, 9, 10, 11, 12, 13, or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of five phosphorothioate or methylphosphonate internucleotide linkages separated by 1, 2, 3, 4, 5, 6, 7, 8, 9, 10, 11, or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of six phosphorothioate or methylphosphonate internucleotide linkages separated by 1, 2, 3, 4, 5, 6, 7, 8, 9, or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of seven phosphorothioate or methylphosphonate internucleotide linkages separated by 1, 2, 3, 4, 5, 6, 7, or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of eight phosphorothioate or methylphosphonate internucleotide linkages separated by 1, 2, 3, 4, 5, or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of nine phosphorothioate or methylphosphonate internucleotide linkages separated by 1, 2, 3, or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the dsRNA molecule of the disclosure further comprises one or more phosphorothioate or methylphosphonate internucleotide linkage modification within 1-10 nucleotides of the termini position(s) of the sense or antisense strand. For example, at least 2, 3, 4, 5, 6, 7, 8, 9, or 10 nucleotides may be linked through phosphorothioate or methylphosphonate internucleotide linkage at one end or both ends of the sense or antisense strand.

In some embodiments, the dsRNA molecule of the disclosure further comprises one or more phosphorothioate or methylphosphonate internucleotide linkage modification within 1-10 nucleotides of the internal region of the duplex of each of the sense or antisense strand. For example, at least 2, 3, 4, 5, 6, 7, 8, 9, or 10 nucleotides may be linked through phosphorothioate or methylphosphonate internucleotide linkage at position 8-16 of the duplex region counting from the 5'-end of the sense strand; the dsRNA molecule can optionally further comprise one or more phosphorothioate or methylphosphonate internucleotide linkage modification within 1-10 of the termini position(s).

In some embodiments, the dsRNA molecule of the disclosure further comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to two phosphorothioate or methylphosphonate internucleotide linkage modification at positions 1 and 2 and one to five within positions 18-23 of the antisense strand (counting from the 5'-end).

In some embodiments, the dsRNA molecule of the disclosure further comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at positions 1 or 2 and two phosphorothioate or methylphosphonate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 (counting from the 5'-end) of the sense strand, and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 (counting from the 5'-end) of the sense strand, and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In some embodiments, compound of the disclosure comprises a pattern of backbone chiral centers. In some embodiments, a common pattern of backbone chiral centers comprises at least 5 internucleotidic linkages in the Sp configuration. In some embodiments, a common pattern of backbone chiral centers comprises at least 6 internucleotidic linkages in the Sp configuration. In some embodiments, a common pattern of backbone chiral centers comprises at least 7 internucleotidic linkages in the Sp configuration. In some embodiments, a common pattern of backbone chiral centers comprises at least 8 internucleotidic linkages in the Sp configuration. In some embodiments, a common pattern of backbone chiral centers comprises at least 9 internucleotidic linkages in the Sp configuration. In some embodiments, a common pattern of backbone chiral centers comprises at least 10 internucleotidic linkages in the Sp configuration. In some embodiments, a common pattern of backbone chiral centers comprises at least 11 internucleotidic linkages in the Sp configuration. In some embodiments, a common pattern of backbone chiral centers comprises at least 12 internucleotidic linkages in the Sp configuration. In some embodiments, a common pattern of backbone chiral centers comprises at least 13 internucleotidic linkages in the Sp configuration. In some embodiments, a common pattern of backbone chiral centers comprises at least 14 internucleotidic linkages in the Sp configuration. In some embodiments, a common pattern of backbone chiral centers comprises at least 15 internucleotidic linkages in the Sp configuration. In some embodiments, a common pattern of backbone chiral centers comprises at least 16 internucleotidic linkages in the Sp configuration. In some embodiments, a common pattern of backbone chiral centers comprises at least 17 internucleotidic linkages in the Sp configuration. In some embodiments, a common pattern of backbone chiral centers comprises at least 18 internucleotidic linkages in the Sp configuration. In some embodiments, a common pattern of backbone chiral centers comprises at least 19 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 7 internucleotidic linkages in the Rp configuration. In some embodiments, a common pattern of backbone chiral centers comprises no more than 6 internucleotidic linkages in the Rp configuration. In some embodiments, a common pattern of backbone chiral centers comprises no more than 5 internucleotidic linkages in the Rp configuration. In some embodiments, a common pattern of backbone chiral centers comprises no more than 4 internucleotidic linkages in the Rp configuration. In some embodiments, a common pattern of backbone chiral centers comprises no more than 3 internucleotidic linkages in the Rp configuration. In some embodiments, a common pattern of backbone chiral centers comprises no more than 2 internucleotidic linkages in the Rp configuration. In some embodiments, a common pattern of backbone chiral centers comprises no more than 1 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 7 internucleotidic linkages which are not chiral. In some embodiments, a common pattern of backbone chiral centers comprises no more than 6 internucleotidic linkages which are not chiral. In some embodiments, a common pattern of backbone chiral centers comprises no more than 5 internucleotidic linkages which are not chiral. In some embodiments, a common pattern of backbone chiral centers comprises no more than 4 internucleotidic linkages which are not chiral. In some embodiments, a common pattern of backbone chiral centers comprises no more than 3 internucleotidic linkages which are not chiral. In some embodiments, a common pattern of backbone chiral centers comprises no more than 2 internucleotidic linkages which are not chiral. In some embodiments, a common pattern of backbone chiral centers comprises no more than 1 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

In some embodiments, compound of the disclosure comprises a block is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage in a natural phosphate linkage.

In some embodiments, compound of the disclosure comprises a 5'-block is an Sp block wherein each sugar moiety comprises a 2'-F modification. In some embodiments, a 5'-block is an Sp block wherein each of internucleotidic linkage is a modified internucleotidic linkage and each sugar moiety comprises a 2'-F modification. In some embodiments, a 5'-block is an Sp block wherein each of internucleotidic linkage is a phosphorothioate linkage and each sugar moiety comprises a 2'-F modification. In some embodiments, a 5'-block comprises 4 or more nucleoside units. In some embodiments, a 5'-block comprises 5 or more nucleoside units. In some embodiments, a 5'-block comprises 6 or more nucleoside units. In some embodiments, a 5'-block comprises 7 or more nucleoside units. In some embodiments, a 3'-block is an Sp block wherein each sugar moiety comprises a 2'-F modification. In some embodiments, a 3'-block is an Sp block wherein each of internucleotidic linkage is a modified internucleotidic linkage and each sugar moiety comprises a 2'-F modification. In some embodiments, a 3'-block is an Sp block wherein each of internucleotidic linkage is a phosphorothioate linkage and each sugar moiety comprises a 2'-F modification. In some embodiments, a 3'-block comprises 4 or more nucleoside units. In some embodiments, a 3'-block comprises 5 or more nucleoside units. In some embodiments, a 3'-block comprises 6 or more nucleoside units. In some embodiments, a 3'-block comprises 7 or more nucleoside units.

In some embodiments, compound of the disclosure comprises a type of nucleoside in a region or an oligonucleotide is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by Sp. In some embodiments, A is followed by Rp. In some embodiments, A is followed by natural phosphate linkage (PO). In some embodiments, U is followed by Sp. In some embodiments, U is followed by Rp. In some embodiments, U is followed by natural phosphate linkage (PO). In some embodiments, C is followed by Sp. In some embodiments, C is followed by Rp. In some embodiments, C is followed by natural phosphate linkage (PO). In some embodiments, G is followed by Sp. In some embodiments, G is followed by Rp. In some embodiments, G is followed by natural phosphate linkage (PO). In some embodiments, C and U are followed by Sp. In some embodiments, C and U are followed by Rp. In some embodiments, C and U are followed by natural phosphate linkage (PO). In some embodiments, A and G are followed by Sp. In some embodiments, A and G are followed by Rp.

In some embodiments, the antisense strand comprises phosphorothioate internucleotide linkages between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5, or 6 2'-fluoro modifications; (ii) the antisense comprises 3, 4, or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4, or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5, or 6 2'-fluoro modifications; (ii) the sense strand is conjugated with a ligand; (iii) the sense strand comprises 2, 3, 4 or 5 2'-fluoro modifications; (iv) the sense strand comprises 1, 2, 3, 4, or 5 phosphorothioate internucleotide linkages; (v) the dsRNA comprises at least four 2'-fluoro modifications; (vi) the dsRNA comprises a duplex region of 12-40 nucleotide pairs in length; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4 or 5 2'-fluoro modifications; (v) the sense strand comprises 3, 4 or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5 or 6 2'-fluoro modifications; (ii) the sense strand is conjugated with a ligand; (iii) the sense strand comprises 2, 3, 4 or 5 2'-fluoro modifications; (iv) the sense strand comprises 3, 4 or 5 phosphorothioate internucleotide linkages; (v) the dsRNA comprises at least four 2'-fluoro modifications; (vi) the dsRNA comprises a duplex region of 12-40 nucleotide pairs in length; and (vii) the dsRNA has a blunt end at 5'-end of the antisense strand.

In some embodiments, the dsRNA molecule of the disclosure comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used).

In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In some embodiments, the dsRNA molecule of the disclosure comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

It was found that introducing 4'-modified or 5'-modified nucleotide to the 3'-end of a phosphodiester (PO), phosphorothioate (PS), or phosphorodithioate (PS2) linkage of a dinucleotide at any position of single stranded or double stranded oligonucleotide can exert steric effect to the internucleotide linkage and, hence, protecting or stabilizing it against nucleases.

In some embodiments, 5'-modified nucleotide is introduced at the 3'-end of a dinucleotide at any position of single stranded or double stranded siRNA. For instance, a 5'-alkylated nucleotide may be introduced at the 3'-end of a dinucleotide at any position of single stranded or double stranded siRNA. The alkyl group at the 5' position of the ribose sugar can be racemic or chirally pure R or S isomer. An exemplary 5'-alkylated nucleotide is 5'-methyl nucleotide. The 5'-methyl can be either racemic or chirally pure R or S isomer.

In some embodiments, 4'-modified nucleotide is introduced at the 3'-end of a dinucleotide at any position of single stranded or double stranded siRNA. For instance, a 4'-alkylated nucleotide may be introduced at the 3'-end of a dinucleotide at any position of single stranded or double stranded siRNA. The alkyl group at the 4' position of the ribose sugar can be racemic or chirally pure R or S isomer. An exemplary 4'-alkylated nucleotide is 4'-methyl nucleotide. The 4'-methyl can be either racemic or chirally pure R or S isomer. Alternatively, a 4'-O-alkylated nucleotide may be introduced at the 3'-end of a dinucleotide at any position of single stranded or double stranded siRNA. The 4'-O-alkyl of the ribose sugar can be racemic or chirally pure R or S isomer. An exemplary 4'-O-alkylated nucleotide is 4'-O-methyl nucleotide. The 4'-O-methyl can be either racemic or chirally pure R or S isomer.

In some embodiments, 5'-alkylated nucleotide is introduced at any position on the sense strand or antisense strand of a dsRNA, and such modification maintains or improves potency of the dsRNA. The 5'-alkyl can be either racemic or chirally pure R or S isomer. An exemplary 5'-alkylated nucleotide is 5'-methyl nucleotide. The 5'-methyl can be either racemic or chirally pure R or S isomer.

In some embodiments, 4'-alkylated nucleotide is introduced at any position on the sense strand or antisense strand of a dsRNA, and such modification maintains or improves potency of the dsRNA. The 4'-alkyl can be either racemic or chirally pure R or S isomer. An exemplary 4'-alkylated nucleotide is 4'-methyl nucleotide. The 4'-methyl can be either racemic or chirally pure R or S isomer.

In some embodiments, 4'-O-alkylated nucleotide is introduced at any position on the sense strand or antisense strand of a dsRNA, and such modification maintains or improves potency of the dsRNA. The 5'-alkyl can be either racemic or chirally pure R or S isomer. An exemplary 4'-O-alkylated nucleotide is 4'-O-methyl nucleotide. The 4'-O-methyl can be either racemic or chirally pure R or S isomer.

In some embodiments, the dsRNA molecule of the disclosure can comprise 2'-5' linkages (with 2'-H, 2'-OH and 2'-OMe and with P═O or P═S). For example, the 2'-5' linkages modifications can be used to promote nuclease resistance or to inhibit binding of the sense to the antisense strand, or can be used at the 5' end of the sense strand to avoid sense strand activation by RISC.

In another embodiment, the dsRNA molecule of the disclosure can comprise L sugars (e.g., L ribose, L-arabinose with 2'-H, 2'-OH and 2'-OMe). For example, these L sugars modifications can be used to promote nuclease resistance or to inhibit binding of the sense to the antisense strand, or can be used at the 5' end of the sense strand to avoid sense strand activation by RISC.

Various publications describe multimeric siRNA which can all be used with the dsRNA of the disclosure. Such publications include WO2007/091269, U.S. Pat. No. 7,858,769, WO2010/141511, WO2007/117686, WO2009/014887, and WO2011/031520 which are hereby incorporated by their entirely.

As described in more detail below, the RNAi agent that contains conjugations of one or more carbohydrate moieties to an RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (in some embodiments, cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," in some embodiments, two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; in some embodiments, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; in some embodiments, the acyclic group is selected from serinol backbone or diethanolamine backbone.

In certain specific embodiments, the RNAi agent for use in the methods of the disclosure is an agent selected from the group of agents listed in any one of Tables 2-9. These agents may further comprise a ligand, such as one or more lipophilic moieties, one or more GalNAc derivatives, or both of one of more lipophilic moieties and one or more GalNAc derivatives.

IV. IRNAS CONJUGATED TO LIGANDS

Another modification of the RNA of an iRNA of the invention involves chemically linking to the iRNA one or more ligands, moieties or conjugates that enhance the activity, cellular distribution or cellular uptake of the iRNA, e.g., into a cell. Such moieties include but are not limited to lipid moieties such as a cholesterol moiety (Letsinger et al., *Proc. Natl. Acid. Sci. USA,* 1989, 86: 6553-6556), cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylamino-carbonyloxycholesterol moiety (Crooke et al., *J. Pharmacol. Exp. Ther.,* 1996, 277:923-937).

In certain embodiments, a ligand alters the distribution, targeting or lifetime of an iRNA agent into which it is incorporated. In some embodiments, a ligand provides an enhanced affinity for a selected target, e.g., molecule, cell or cell type, compartment, e.g., a cellular or organ compartment, tissue, organ or region of the body, as, e.g., compared to a species absent such a ligand. Typical ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an α helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid,O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. Such a lipid or lipid-based molecule can typically bind a serum protein, such as human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid-based ligand can be used to modulate, e.g., control (e.g., inhibit) the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid-based ligand binds HSA. For example, the ligand can bind HSA with a sufficient affinity such that distribution of the conjugate to a non-kidney tissue is enhanced. However, the affinity is typically not so strong that the HSA-ligand binding cannot be reversed.

In certain embodiments, the lipid-based ligand binds HSA weakly or not at all, such that distribution of the conjugate to the kidney is enhanced. Other moieties that target to kidney cells can also be used in place of or in addition to the lipid-based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low density lipoprotein (LDL).

B. Cell Permeation Agents

In another aspect, the ligand is a cell-permeation agent, such as a helical cell-permeation agent. In certain embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is typically an α-helical agent and can have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 15). An RFGF analogue (e.g., amino acid sequence AALLPVLLAAP (SEQ ID NO: 16) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 1)) and the *Drosophila Antennapedia* protein (RQIKIWFQNRRMKWKK (SEQ ID NO: 18) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., *Nature,* 354:82-84, 1991). Typically, the peptide or peptidomimetic tethered to a dsRNA agent via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

An RGD peptide moiety can be used to target a particular cell type, e.g., a tumor cell, such as an endothelial tumor cell or a breast cancer tumor cell (Zitzmann et al., *Cancer Res.,* 62:5139-43, 2002). An RGD peptide can facilitate targeting of an dsRNA agent to tumors of a variety of other tissues, including the lung, kidney, spleen, or liver (Aoki et al., *Cancer Gene Therapy* 8:783-787, 2001). Typically, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver an iRNA agent to a tumor cell expressing $\alpha_v\beta_3$ (Haubner et al., *Jour. Nucl. Med.,* 42:326-336, 2001).

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., *Nucl. Acids Res.* 31:2717-2724, 2003).

C. Carbohydrate Conjugates

In some embodiments of the compositions and methods of the invention, an iRNA further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and tri-saccharides include sugars having two or three monosaccharide units (e.g., C5, C6, C7, or C8).

In certain embodiments, a carbohydrate conjugate comprises a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, the GalNAc conjugate is

Formula II

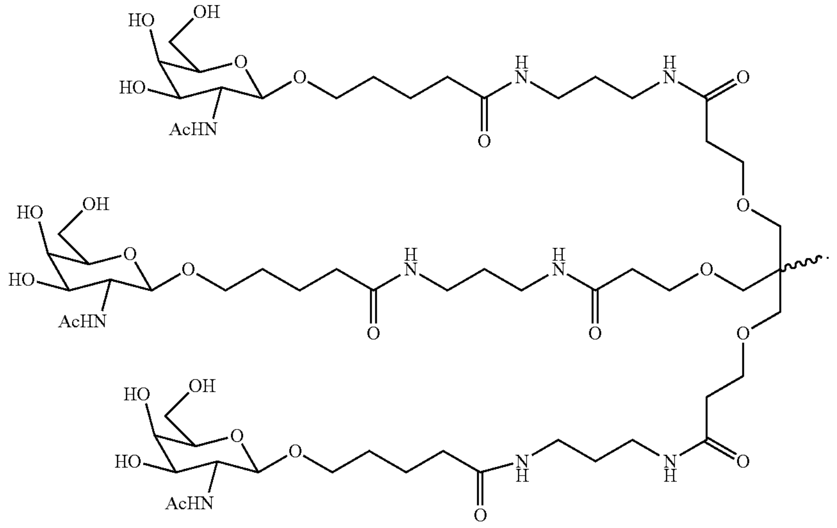

In some embodiments, the RNAi agent is attached to the carbohydrate conjugate via a linker as shown in the following schematic, wherein X is O or S

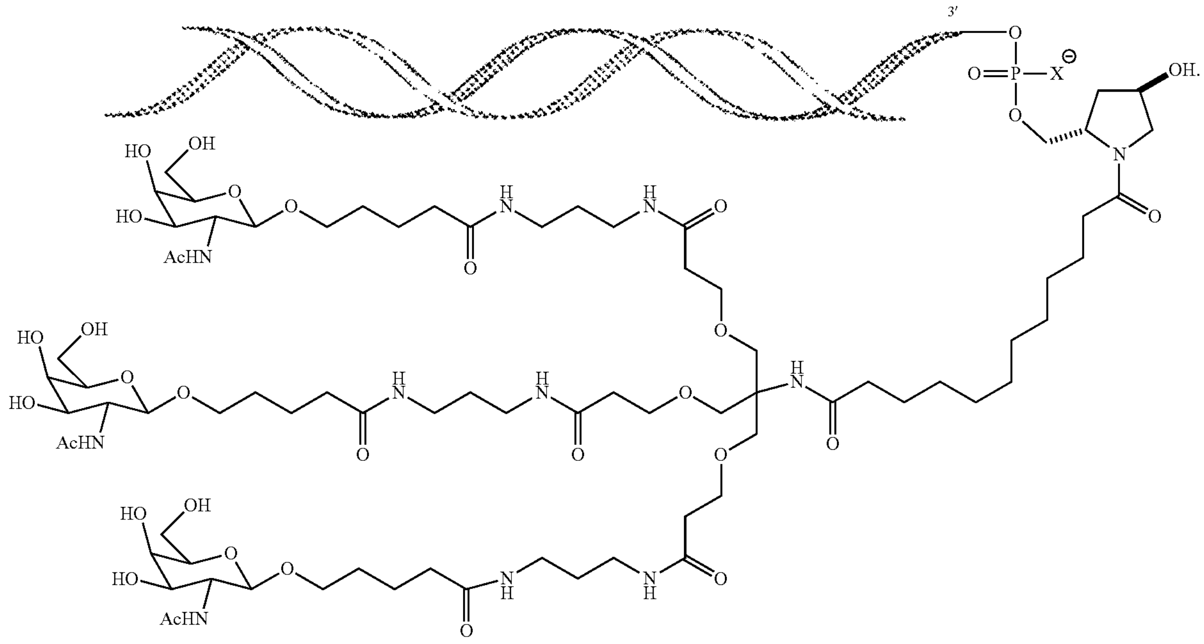

In some embodiments, the RNAi agent is conjugated to L96 as defined in Table 1 and shown below:

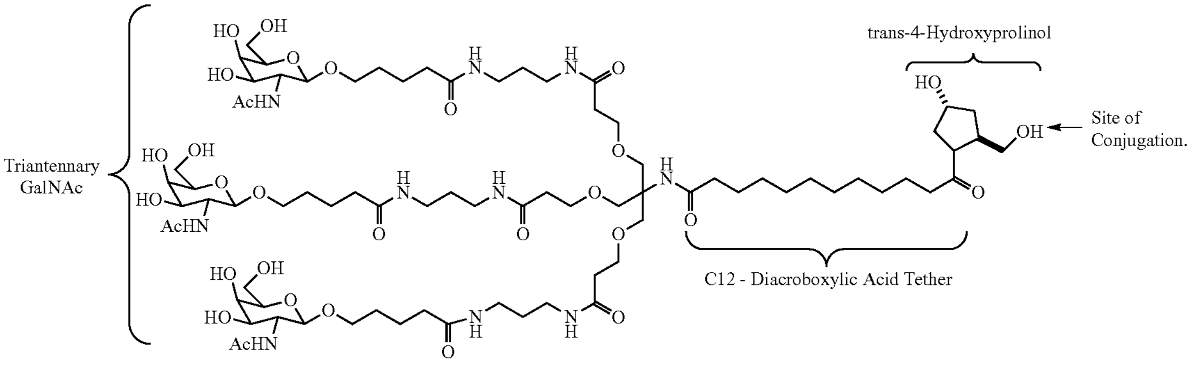
In certain embodiments, a carbohydrate conjugate for use in the compositions and methods of the invention is selected from the group consisting of:
Formula II
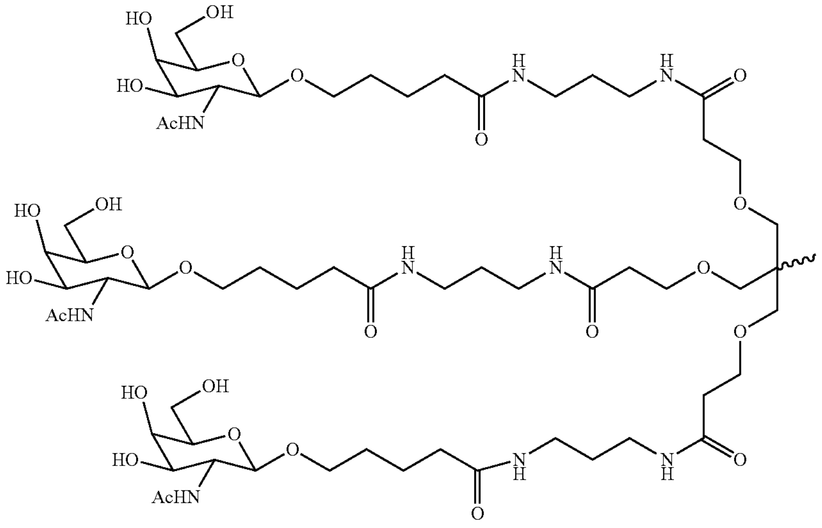
,
Formula III
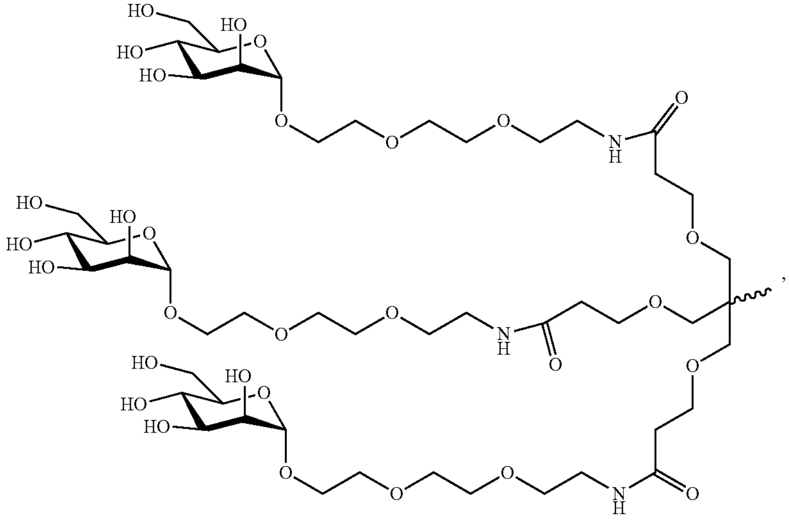
, -continued
Formula IV
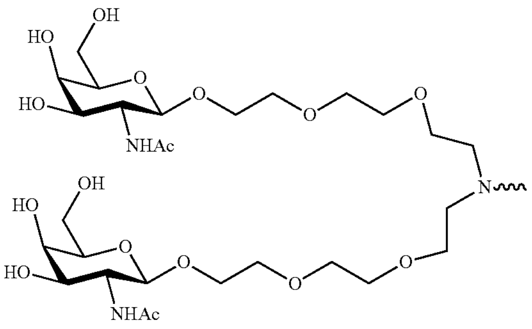
,
Formula V
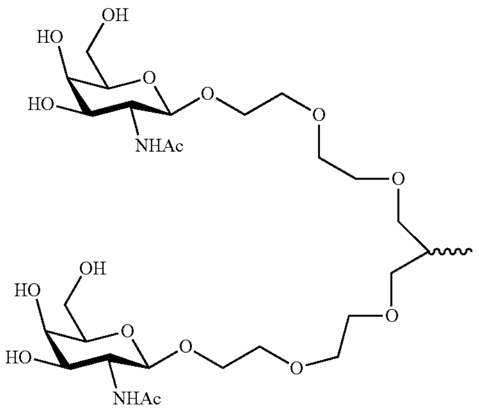
,
Formula VI
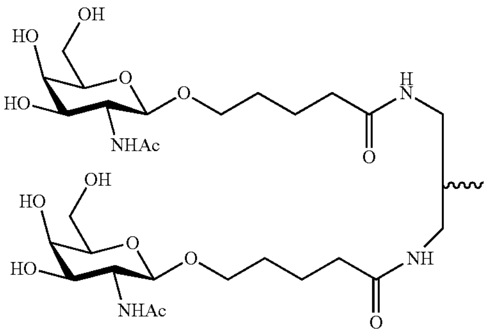
,
Formula VII
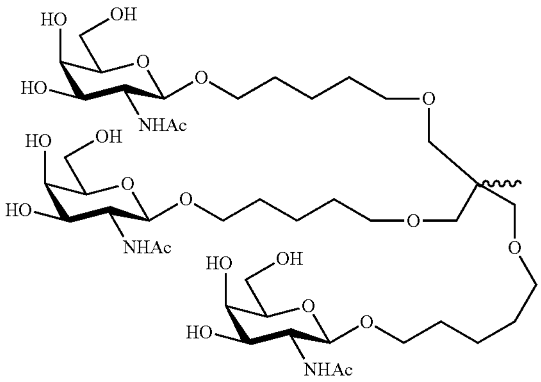
,
Formula VIII
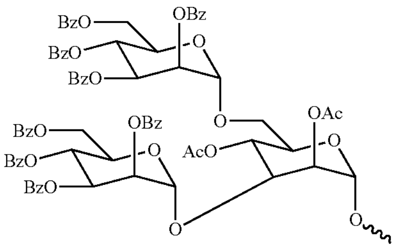
,
Formula IX
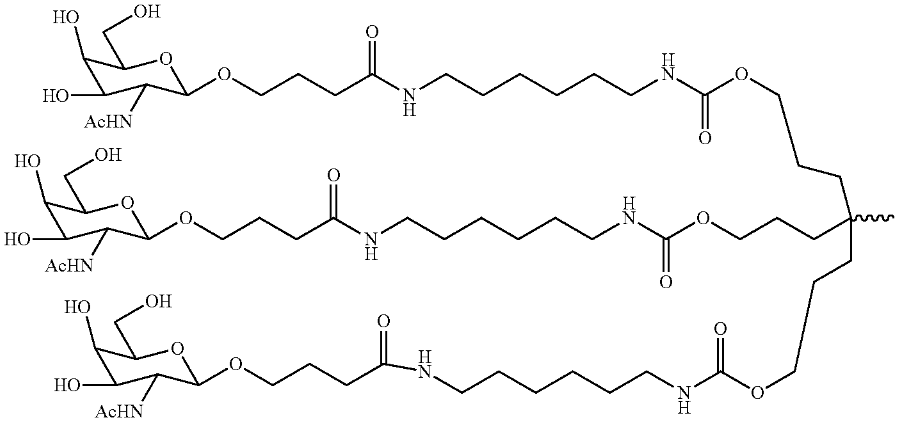
, -continued
Formula X
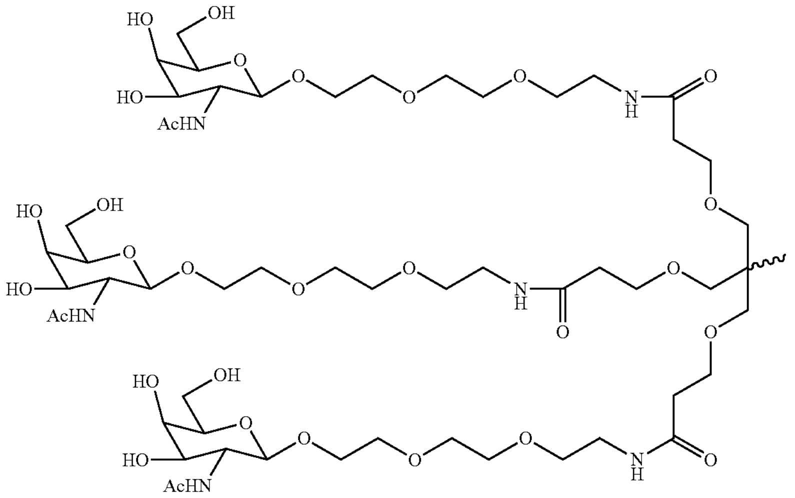
,
Formula XI
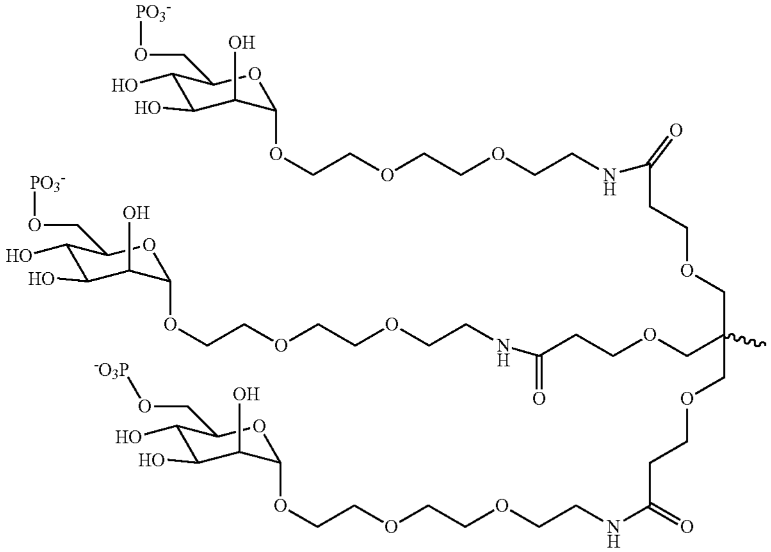
,
Formula XII
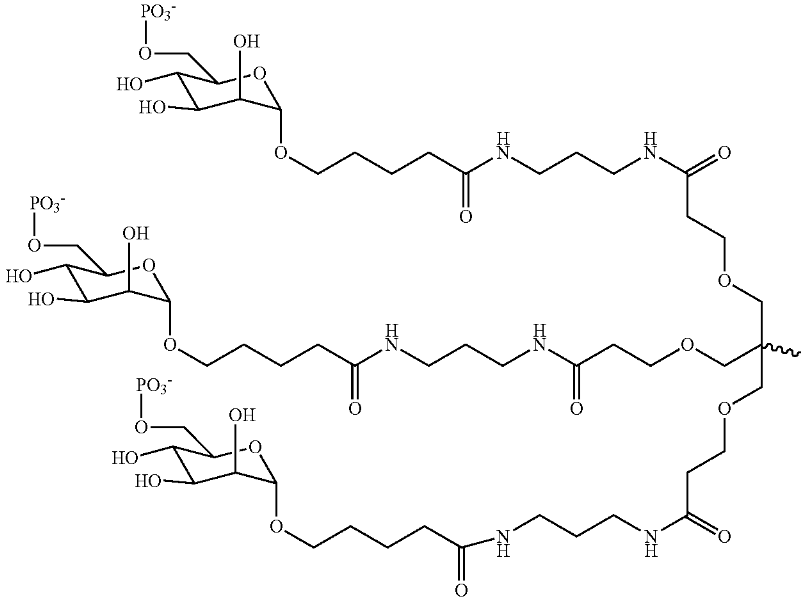
, -continued
Formula XIII
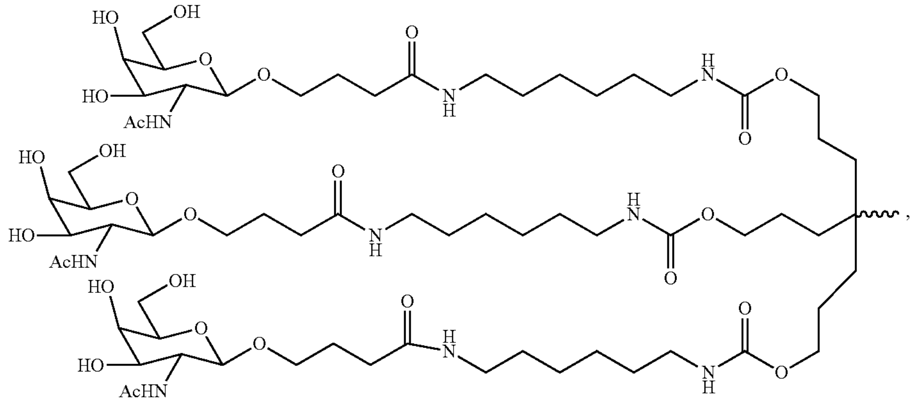
Formula XIV
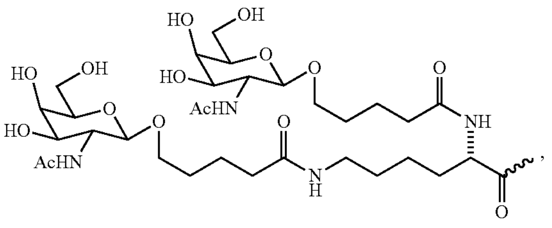
Formula XV
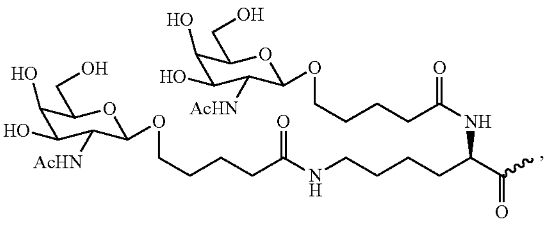
Formula XVI
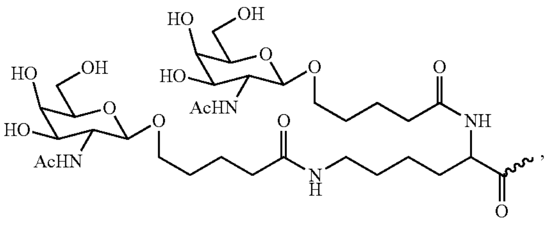
Formula XVII
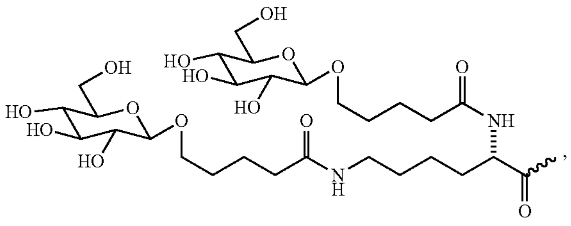
Formula XVIII
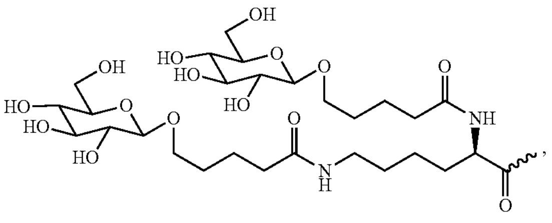
Formula XIX
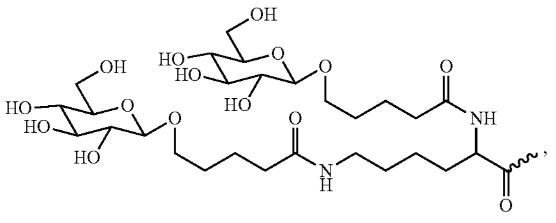
Formula XX
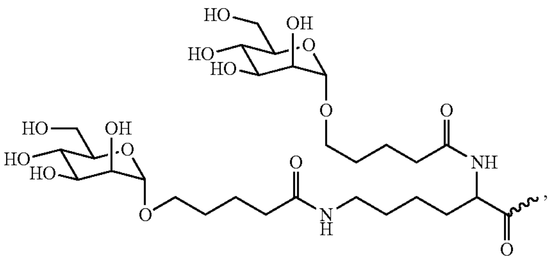
Formula XXI
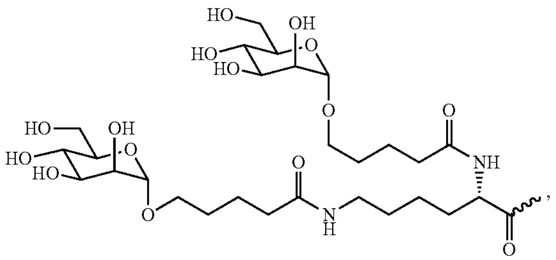

-continued
Formula XXII
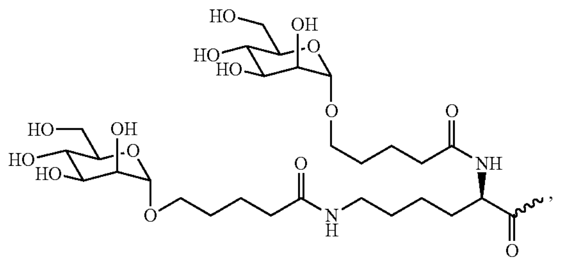
Formula XXIII
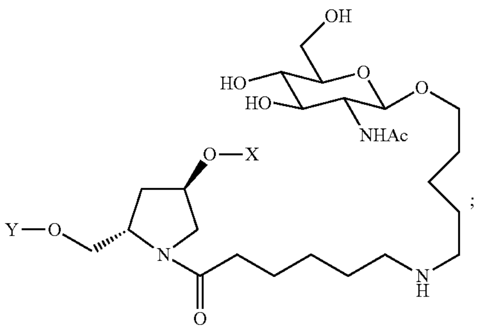
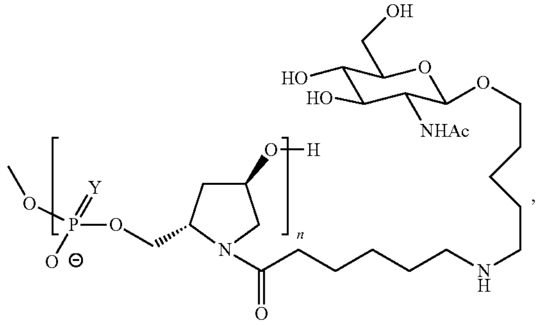
wherein Y is O or S and n is 3-6 (Formula XXIV);
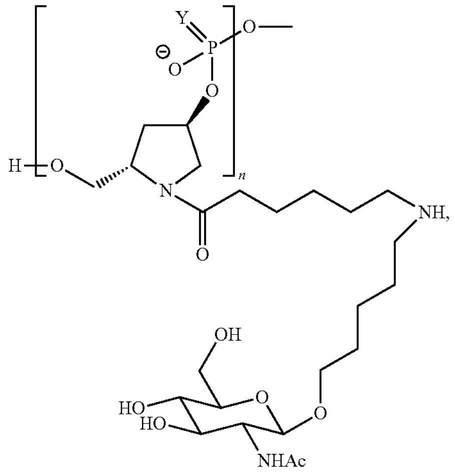
wherein Y is O or S and n is 3-6 (Formula XXV);
Formula XXVI
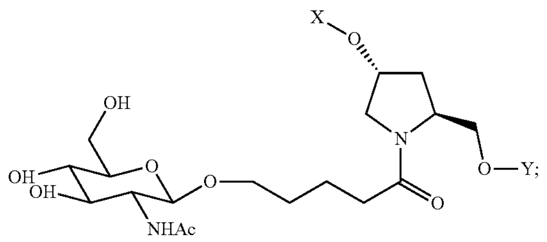

-continued
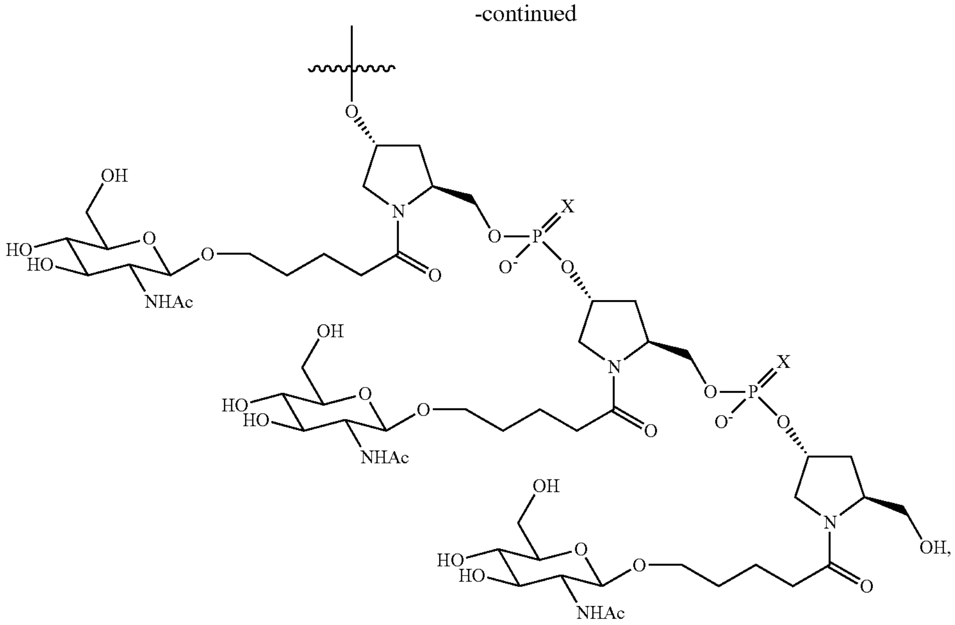
wherein X is O or S (Formula XXVII);
Formula XXVII
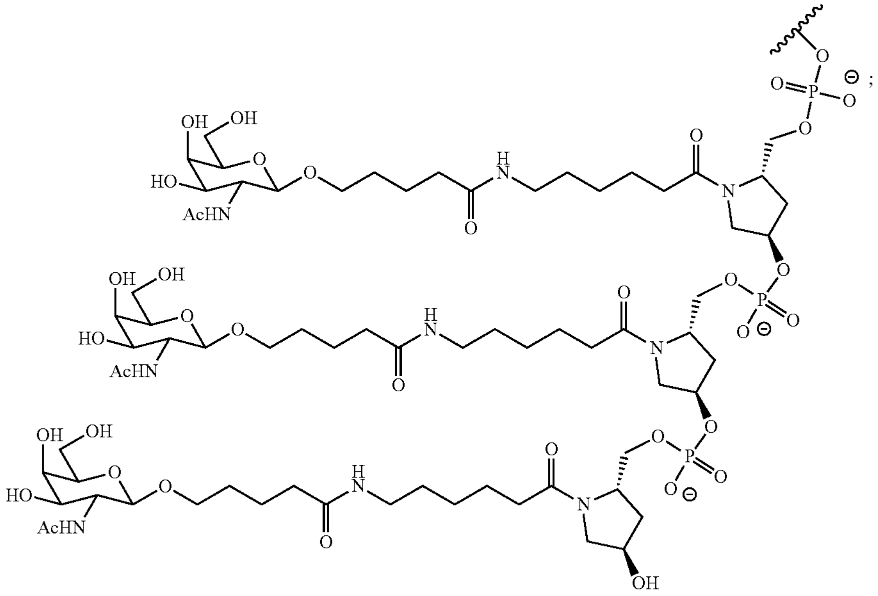

-continued
Formula XXIX
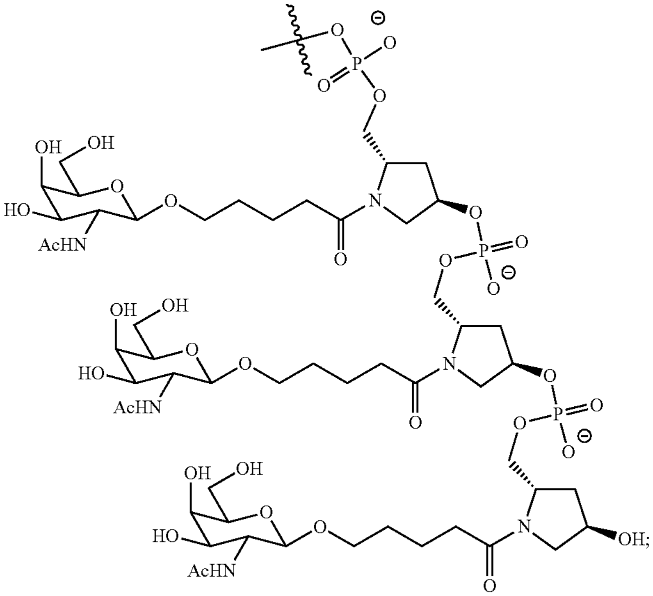
Formula XXX
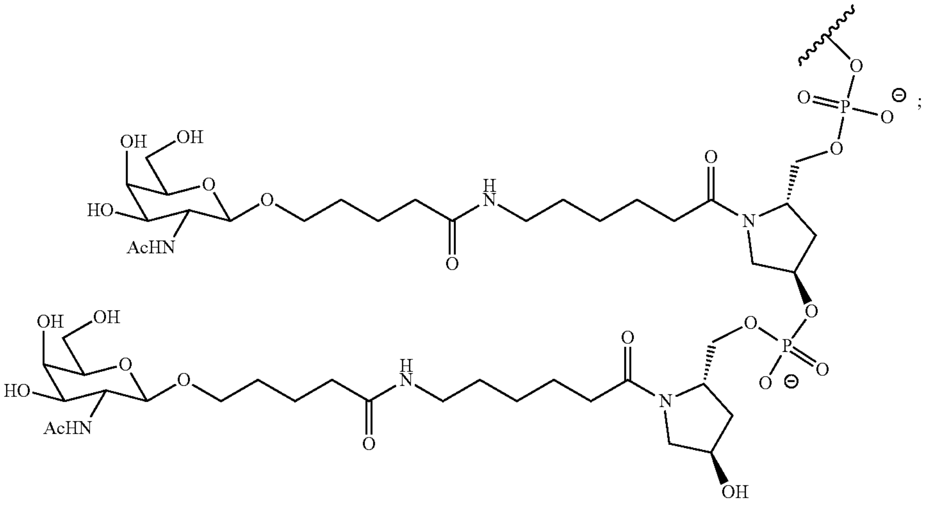
Formula XXXI
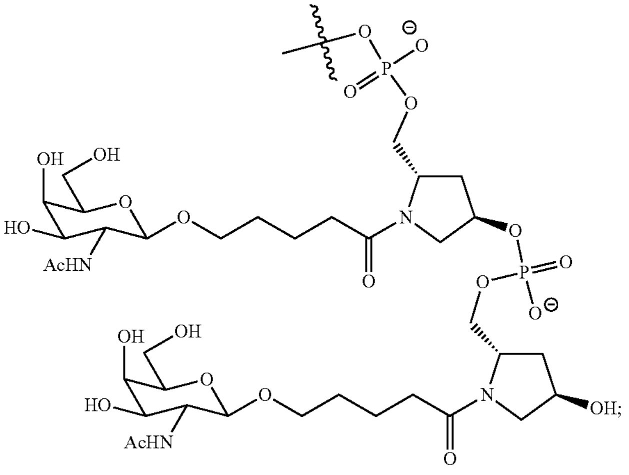

-continued
Formula XXXII
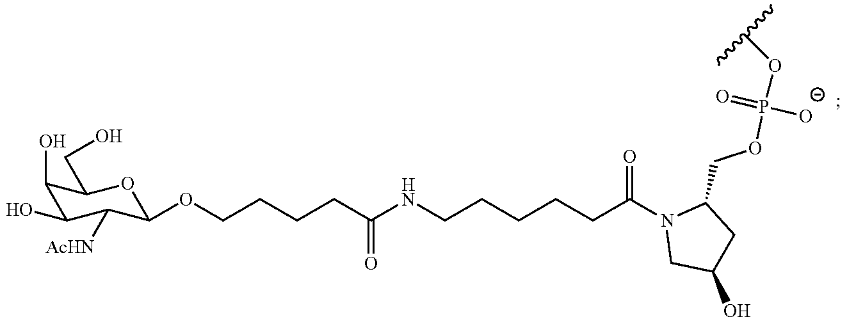
; and
Formula XXXIII
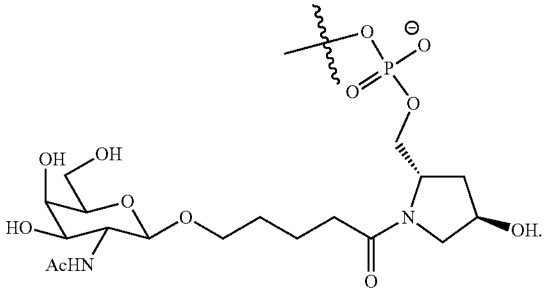
Formula XXXIV
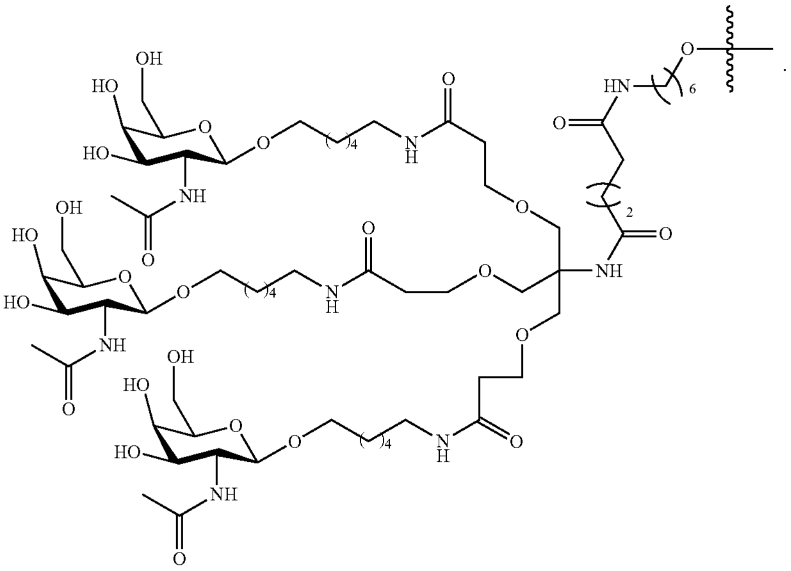
In certain embodiments, a carbohydrate conjugate for use in the compositions and methods of the invention is a monosaccharide. In certain embodiments, the monosaccharide is an N-acetylgalactosamine, such as Formula II

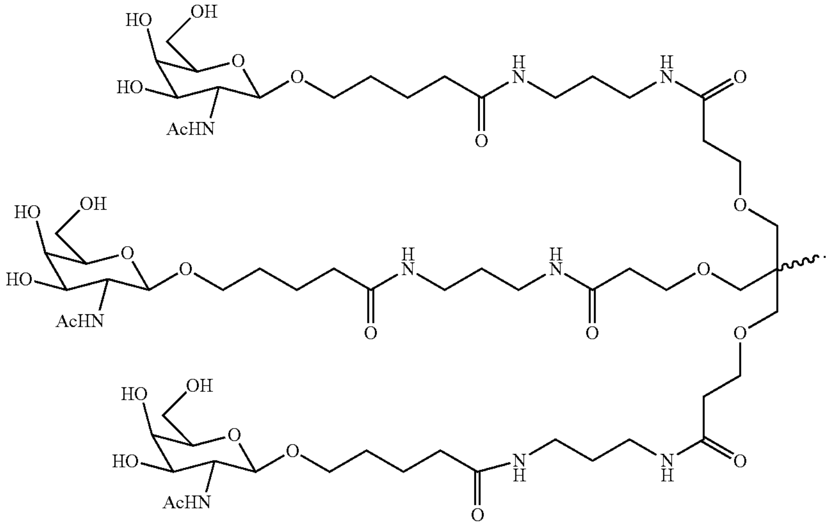

Another representative carbohydrate conjugate for use in the embodiments described herein includes, but is not limited to, (Formula XXXVI)

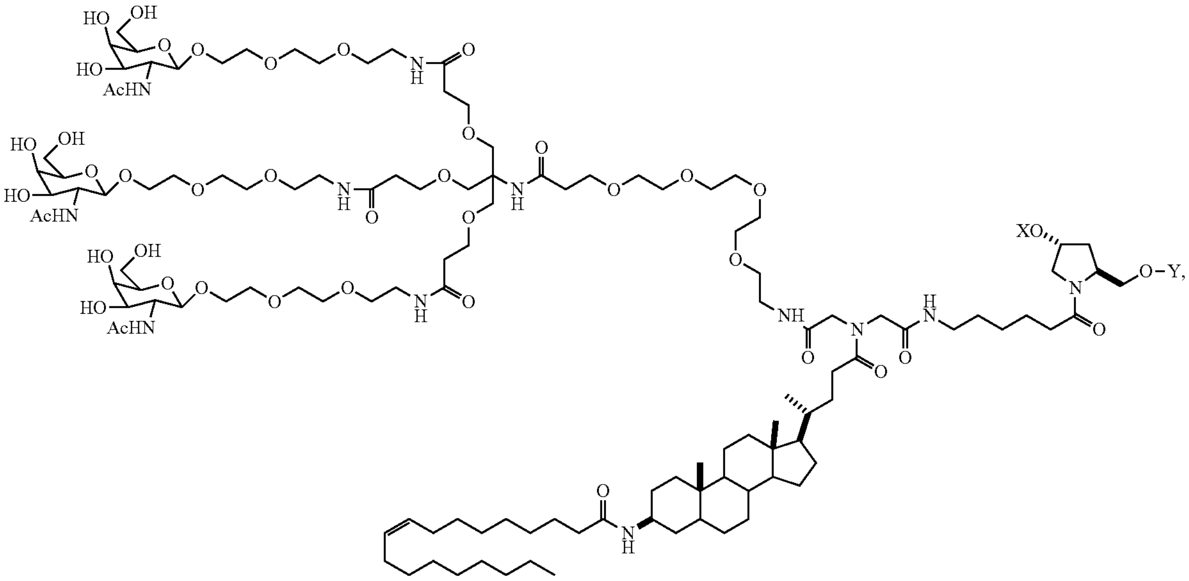

when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

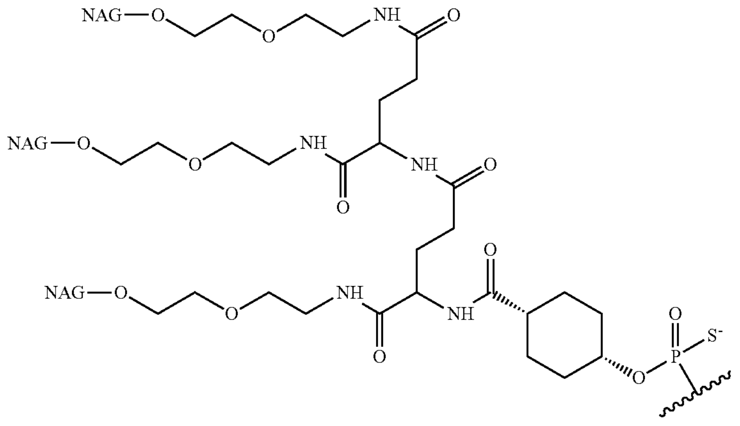

(NAG37)s

In certain embodiments, the RNAi agents of the disclosure may include GalNAc ligands, even if such GalNAc ligands are currently projected to be of limited value for the preferred intrathecal/CNS delivery route(s) of the instant disclosure.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent, e.g., the 5'end of the sense strand of a dsRNA agent, or the 5' end of one or both sense strands of a dual targeting RNAi agent as described herein. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In certain embodiments, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In certain embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S, wherein Rk at each occurrence can be, independently, C1-C20 alkyl, C1-C20 haloalkyl, C6-C10 aryl, or C7-C12 aralkyl. Exemplary embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. In one embodiment, a phosphate-based linking group is —O—P(O)(OH)—O—. These candidates can be evaluated using methods analogous to those described above.

iii. Acid Cleavable Linking Groups

In certain embodiments, a cleavable linker comprises an acid cleavable linking group. An acid cleavable linking group is a linking group that is cleaved under acidic conditions. In some embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Cleavable Linking Groups

In certain embodiments, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleavable Linking Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to, (Formula XXXVII)

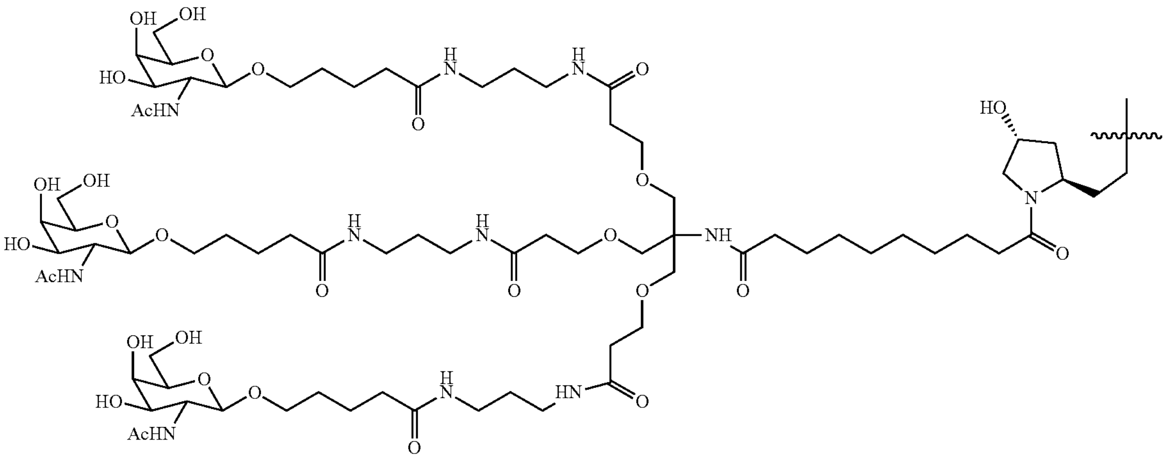

, (Formula XXXVIII)

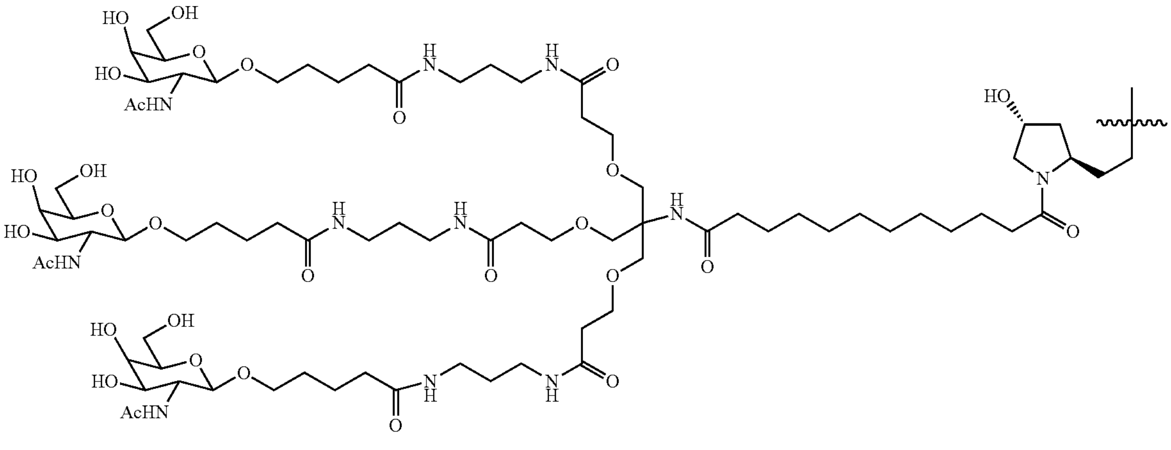

,

-continued
(Formula XXXIX)
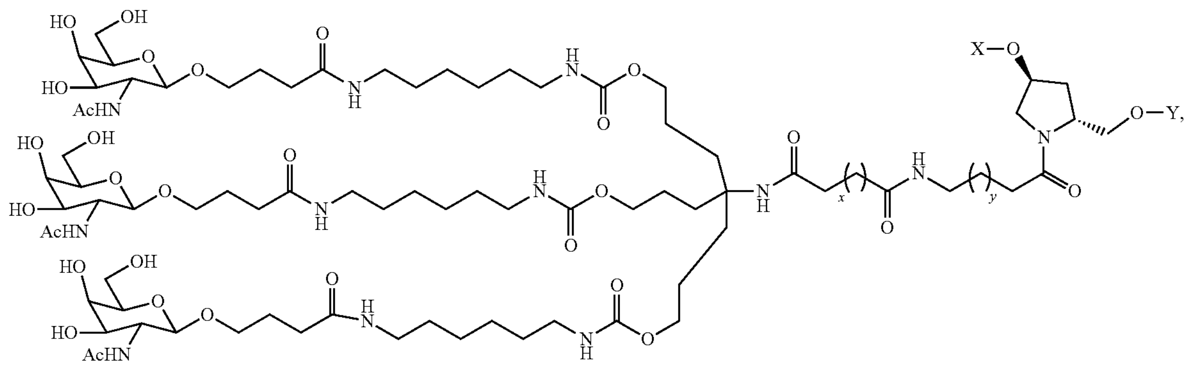
x = 1-30
y = 1-15
(Formula XL)
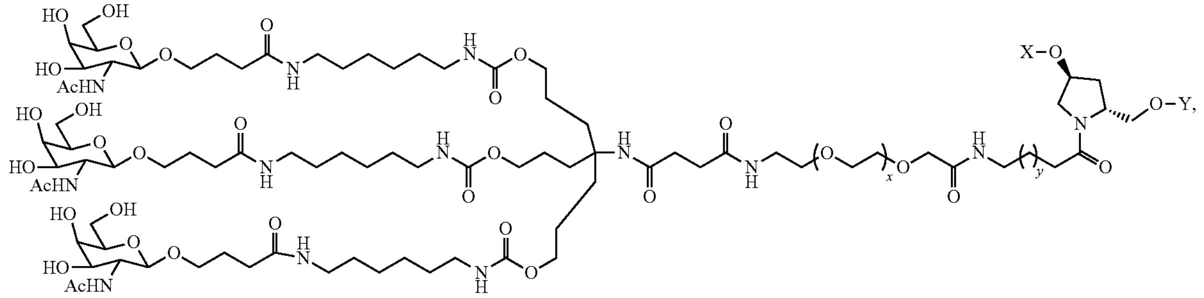
x = 1-30
y = 1-15
(Formula XLI)
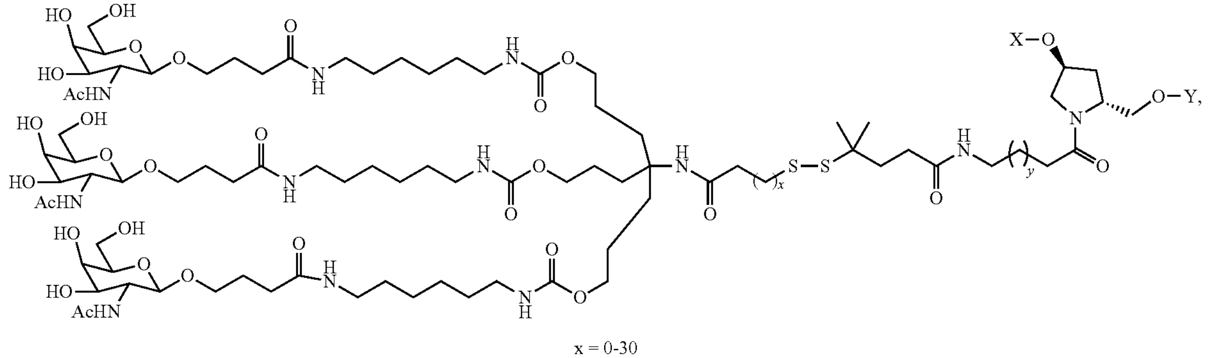
x = 0-30
y = 1-15

-continued (Formula XLII)

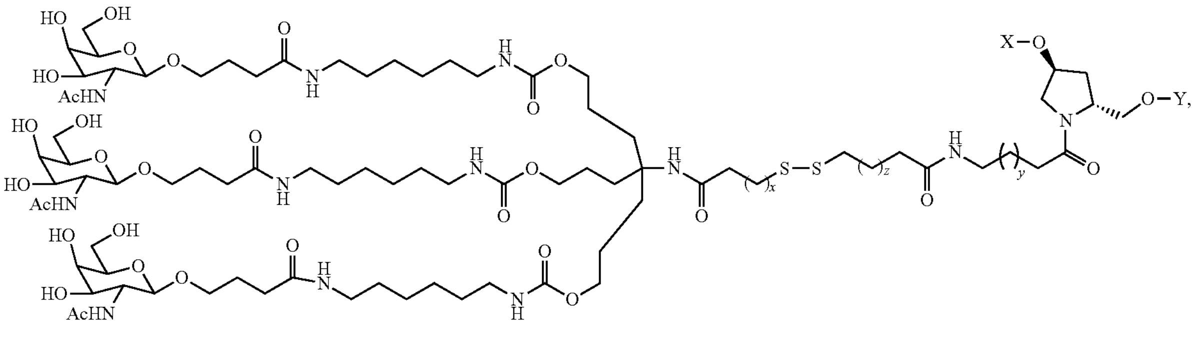

x =0-30
y = 1-15
z = 1-20

(Formula XLIII)

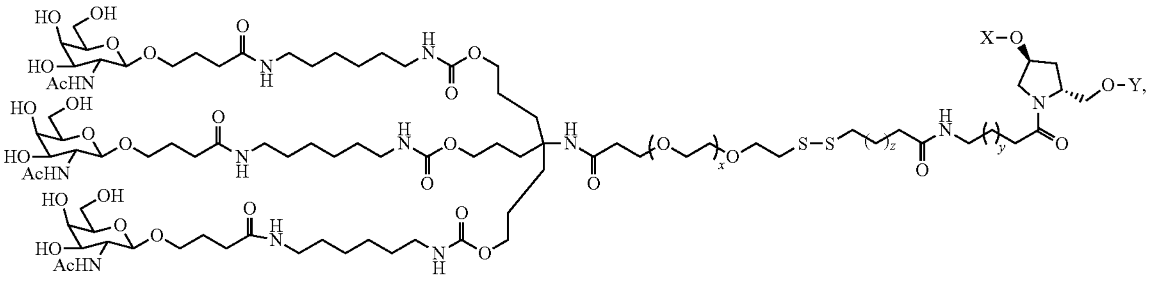

and x = 1-30
y = 1-15
z = 1-20

(Formula XLIV)

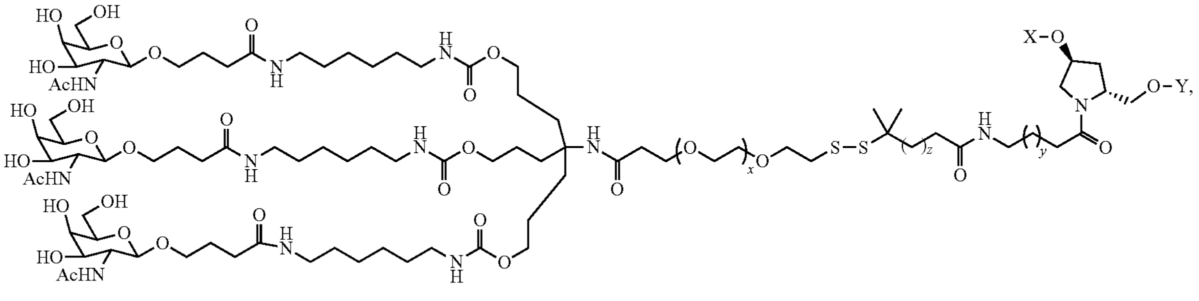

x = 1-30
y = 1-15
z = 1-20 when one of X or Y is an oligonucleotide, the other is a hydrogen.

In certain embodiments of the compositions and methods of the invention, a ligand is one or more "GalNAC" (N-acetylgalactosamine) derivatives attached through a bivalent or trivalent branched linker.

In certain embodiments, a dsRNA of the invention is conjugated to a bivalent or trivalent branched linker selected from the group of structures shown in any of formula (XLV)-(XLVI):

Formula XXXXV (IV)

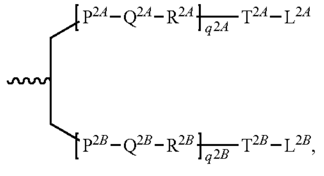

-continued

Formula XLVI

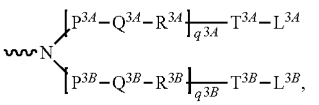

V)

Formula XLVII

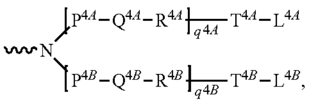

Formula XLVIII

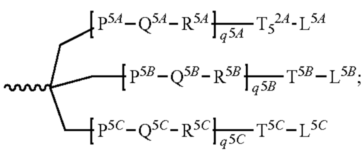

wherein:

$q2A$, $q2B$, $q3A$, $q3B$, $q4A$, $q4B$, $q5A$, $q5B$ and $q5C$ represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $R^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R"), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent,

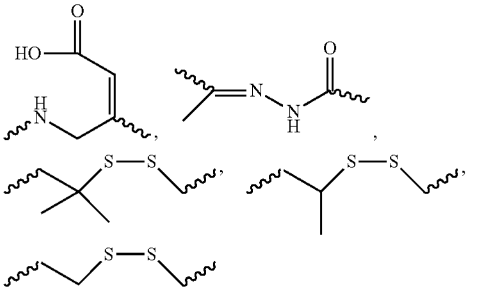

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

Formula XLIX

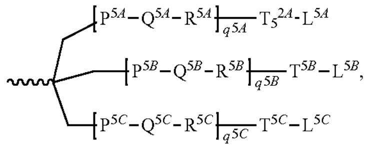

Form wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. Patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, in some embodiments, dsRNA agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.,* 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), a thioether, e.g., hexyl-S-tritylthiol (Manoharan et al., *Ann. N.Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative U.S. patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

V. PHARMACEUTICAL COMPOSITIONS SUITABLE FOR OCULAR OR NEURAL DELIVERY

The present disclosure also includes pharmaceutical compositions and formulations which include the RNAi agents of the disclosure. In one embodiment, provided herein are pharmaceutical compositions containing an RNAi agent, as described herein, and a pharmaceutically acceptable carrier.

In one embodiment, the pharmaceutical compositions are suitable for ocular delivery and comprise an iRNA, as described herein, and a pharmaceutically acceptable carrier. The pharmaceutical compositions containing the iRNA are useful for treating an ocular disease or disorder associated with the expression or activity of a C3 gene, e.g., expression of a C3 gene in the eye of a subject. The pharmaceutical compositions of the invention may be administered in dosages sufficient to inhibit expression of a C3 gene in an eye cell.

In another embodiment, the pharmaceutical compositions are suitable for neural delivery and comprise an iRNA, as described herein, and a pharmaceutically acceptable carrier. The pharmaceutical compositions containing the iRNA are useful for treating a neurodengenerative disease or disorder associated with the expression or activity of a C3 gene, e.g., expression of a C3 gene in the brain or spinal cord of a subject. The pharmaceutical compositions of the invention may be administered in dosages sufficient to inhibit expression of a C3 gene in a neural cell.

Such pharmaceutical compositions are formulated based on the mode of delivery. One example is compositions that are formulated for systemic administration via parenteral delivery, e.g., by intravenous (IV), intramuscular (IM), or for subcutaneous (subQ) delivery. Another example is compositions that are formulated for direct delivery into the CNS, e.g., by intrathecal or intraventricular routes of injection, optionally by infusion into the brain (e.g., striatum), such as by continuous pump infusion.

In some embodiments, the pharmaceutical compositions of the invention are pyrogen free or non-pyrogenic.

The pharmaceutical compositions of the disclosure may be administered in dosages sufficient to inhibit expression of a C3 gene. In general, a suitable dose of an RNAi agent of the disclosure will be a flat dose in the range of about 0.001 to about 200.0 mg about once per month to about once per year, typically about once per quarter (i.e., about once every three months) to about once per year, generally a flat dose in the range of about 1 to 50 mg about once per month to about once per year, typically about once per quarter to about once per year.

After an initial treatment regimen (e.g., loading dose), the treatments can be administered on a less frequent basis.

The skilled artisan will appreciate that certain factors can influence the dosage and timing required to effectively treat a subject, including but not limited to the severity of the disease or disorder, previous treatments, the general health or age of the subject, and other diseases present. Moreover, treatment of a subject with a therapeutically effective amount of a composition can include a single treatment or a series of treatments.

Advances in mouse genetics have generated a number of mouse models for the study of various C3-associated neurodegenerative diseases that would benefit from reduction in the expression of C3. Such models can be used for in vivo testing of RNAi agents, as well as for determining a therapeutically effective dose. Suitable mouse models are known in the art and include, for example, the mouse models described elsewhere herein.

The pharmaceutical compositions of the present disclosure can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The RNAi agents can be delivered in a manner to target a particular tissue, such as the liver, the CNS (e.g., neuronal, glial or vascular tissue of the brain), or both the liver and CNS, the eye, or both the liver and the eye.

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the RNAi agents featured in the disclosure are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). RNAi agents featured in the disclosure can be encapsulated within liposomes or can form complexes thereto, in particular to cationic liposomes. Alternatively, RNAi agents can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

For ocular administration, ointments or droppable liquids may be delivered by ocular delivery systems known to the art such as applicators or eye droppers. Such compositions can include mucomimetics such as hyaluronic acid, chondroitin sulfate, hydroxypropyl methylcellulose or poly(vinyl alcohol), preservatives such as sorbic acid, EDTA or benzylchronium chloride, and the usual quantities of diluents or carriers.

For ocular administration, the siRNAs, double stranded RNA agents of the invention may be applied to the surface of the eye or nearby tissue, e.g., the inside of the eyelid. They can be applied topically, e.g., by spraying, in drops, as an eyewash, or an ointment. Administration can be provided by the subject or by another person, e.g., a health care provider. The medication can be provided in measured doses or in a dispenser which delivers a metered dose. The medication can also be administered to the interior of the eye, and can be introduced by a needle or other delivery device which can introduce it to a selected area or structure.

In one embodiment, the siRNAs, double stranded RNA agents of the invention, are administered to an ocular cell in a pharmaceutical composition by a topical route of administration.

In one embodiment, the pharmaceutical composition suitable for ocular delivery may include an siRNA compound mixed with a topical delivery agent. The topical delivery agent can be a plurality of microscopic vesicles. The microscopic vesicles can be liposomes. In some embodiments the liposomes are cationic liposomes.

In another embodiment, the dsRNA agent is admixed with a topical penetration enhancer. In one embodiment, the topical penetration enhancer is a fatty acid. The fatty acid can be arachidonic acid, oleic acid, lauric acid, caprylic acid, capric acid, myristic acid, palmitic acid, stearic acid, linoleic acid, linolenic acid, dicaprate, tricaprate, monolein, dilaurin, glyceryl 1-monocaprate, 1-dodecylazacycloheptan-2-one, an acylcarnitine, an acylcholine, or a $C_{1-10}$ alkyl ester, monoglyceride, diglyceride or pharmaceutically acceptable salt thereof.

In another embodiment, the topical penetration enhancer is a bile salt. The bile salt can be cholic acid, dehydrocholic acid, deoxycholic acid, glucholic acid, glycholic acid, glycodeoxycholic acid, taurocholic acid, taurodeoxycholic acid, chenodeoxycholic acid, ursodeoxycholic acid, sodium tauro-24,25-dihydro-fusidate, sodium glycodihydrofusidate, polyoxyethylene-9-lauryl ether or a pharmaceutically acceptable salt thereof.

In another embodiment, the penetration enhancer is a chelating agent. The chelating agent can be EDTA, citric acid, a salicyclate, a N-acyl derivative of collagen, laureth-9, an N-amino acyl derivative of a beta-diketone or a mixture thereof.

In another embodiment, the penetration enhancer is a surfactant, e.g., an ionic or nonionic surfactant. The surfactant can be sodium lauryl sulfate, polyoxyethylene-9-lauryl ether, polyoxyethylene-20-cetyl ether, a perfluorochemical emulsion or mixture thereof.

In another embodiment, the penetration enhancer can be selected from a group consisting of unsaturated cyclic ureas, 1-alkyl-alkones, 1-alkenylazacyclo-alakanones, steroidal anti-inflammatory agents and mixtures thereof. In yet another embodiment the penetration enhancer can be a glycol, a pyrrol, an azone, or a terpenes.

In one aspect, the invention features a pharmaceutical composition suitable for ocular administration including an siRNA compound and a delivery vehicle. In one embodiment, the siRNA compound is (a) is 19-25 nucleotides long, for example, 21-23 nucleotides, (b) is complementary to an endogenous target RNA, and, optionally, (c) includes at least one 3' overhang 1-5 nucleotides long.

In one embodiment, the delivery vehicle can deliver an siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) to an ocular cell by a topical route of administration. The delivery vehicle can be microscopic vesicles. In one example the microscopic vesicles are liposomes. In some embodiments the liposomes are cationic liposomes. In another example the microscopic vesicles are micelles. In one aspect, the invention features a pharmaceutical composition including an siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) in an injectable dosage form. In one embodiment, the injectable dosage form of the pharmaceutical composition includes sterile aqueous solutions or dispersions and sterile powders. In some embodiments the sterile solution can include a diluent such as water; saline solution; fixed oils, polyethylene glycols, glycerin, or propylene glycol.

The iRNA molecules of the invention can be incorporated into pharmaceutical compositions suitable for ocular administration. Such compositions typically include one or more species of iRNA and a pharmaceutically acceptable carrier. As used herein the language “pharmaceutically acceptable carrier” is intended to include any and all solvents, dispersion media, coatings, antibacterial and antifungal agents, isotonic and absorption delaying agents, and the like, compatible with pharmaceutical administration to an ocular cell. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

In certain embodiments, the double-stranded iRNA agents may be delivered directly to the eye by ocular tissue injection such as periocular, conjunctival, subtenon, intracameral, intravitreal, intraocular, anterior or posterior juxtascleral, subretinal, subconjunctival, retrobulbar, or intracanalicular injections; by direct application to the eye using a catheter or other placement device such as a retinal pellet, intraocular insert, suppository or an implant comprising a porous, non-porous, or gelatinous material; by topical ocular drops or ointments; or by a slow release device in the cul-de-sac or implanted adjacent to the sclera (transscleral) or in the sclera (intrascleral) or within the eye. Intracameral injection may be through the cornea into the anterior chamber to allow the agent to reach the trabecular meshwork. Intracanalicular injection may be into the venous collector channels draining Schlemm's canal or into Schlemm's canal.

In one embodiment, the double-stranded iRNA agents may be administered into the eye, for example the vitreous chamber of the eye, by intravitreal injection, such as with pre-filled syringes in ready-to-inject form for use by medical personnel.

For ophthalmic delivery, the double-stranded iRNA agents may be combined with ophthalmologically acceptable preservatives, co-solvents, surfactants, viscosity enhancers, penetration enhancers, buffers, sodium chloride, or water to form an aqueous, sterile ophthalmic suspension or solution. Solution formulations may be prepared by dissolving the conjugate in a physiologically acceptable isotonic aqueous buffer. Further, the solution may include an acceptable surfactant to assist in dissolving the double-stranded iRNA agents. Viscosity building agents, such as hydroxymethyl cellulose, hydroxyethyl cellulose, methylcellulose, polyvinylpyrrolidone, or the like may be added to the pharmaceutical compositions to improve the retention of the double-stranded iRNA agents.

To prepare a sterile ophthalmic ointment formulation, the double-stranded iRNA agents is combined with a preservative in an appropriate vehicle, such as mineral oil, liquid lanolin, or white petrolatum. Sterile ophthalmic gel formulations may be prepared by suspending the double-stranded iRNA agents in a hydrophilic base prepared from the combination of, for example, CARBOPOL®-940 (BF Goodrich, Charlotte, N.C.), or the like, according to methods known in the art.

In one embodiment, the double-stranded RNAi agent is formulated for intrathecal injection (i.e., injection into the spinal fluid which bathes the brain and spinal cord tissue). Intrathecal injection of RNAi agents into the spinal fluid can be performed as a bolus injection or via minipumps which can be implanted beneath the skin, providing a regular and constant delivery of siRNA into the spinal fluid. The circulation of the spinal fluid from the choroid plexus, where it is produced, down around the spinal cord and dorsal root ganglia and subsequently up past the cerebellum and over the cortex to the arachnoid granulations, where the fluid can exit the CNS, that, depending upon size, stability, and solubility of the compounds injected, molecules delivered intrathecally could hit targets throughout the entire CNS.

In some embodiments, the intrathecal administration is via a pump. The pump may be a surgically implanted osmotic pump. In one embodiment, the osmotic pump is implanted into the subarachnoid space of the spinal canal to facilitate intrathecal administration.

In some embodiments, the intrathecal administration is via an intrathecal delivery system for a pharmaceutical including a reservoir containing a volume of the pharmaceutical agent, and a pump configured to deliver a portion of the pharmaceutical agent contained in the reservoir. More details about this intrathecal delivery system may be found in WO 2015/116658, which is incorporated by reference in its entirety.

The amount of intrathecally injected RNAi agents may vary from one target gene to another target gene and the appropriate amount that has to be applied may have to be determined individually for each target gene. Typically, this amount ranges from 10 μg to 2 mg, and in some embodiments 50 g to 1500 μg, and in other embodiments 100 μg to 1000 μg.

A. RNAi Agent Formulations Comprising Membranous Molecular Assemblies

A RNAi agent for use in the compositions and methods of the disclosure can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the RNAi agent composition. The lipophilic material isolates the aqueous interior from an aqueous exterior, which typically does not include the RNAi agent composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the RNAi agent are delivered into the cell where the RNAi agent can specifically bind to a target RNA and can mediate RNAi. In some cases the liposomes are also specifically targeted, e.g., to direct the RNAi agent to particular cell types.

A liposome containing an RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., (1987) *Proc. Natl. Acad. Sci. USA* 8:7413-7417; U.S. Pat. Nos. 4,897,355; 5,171,678; Bangham et al., (1965) *M. Mol. Biol.* 23:238; Olson et al., (1979) *Biochim. Biophys. Acta* 557:9; Szoka et al., (1978) *Proc. Natl. Acad. Sci.* 75: 4194; Mayhew et al., (1984) *Biochim. Biophys. Acta* 775:169; Kim et al., (1983) *Biochim. Biophys. Acta* 728:339; and Fukunaga et al., (1984) *Endocrinol.* 115:757. Commonly used techniques for preparing lipid aggregates of appropriate size for use as delivery vehicles include sonication and freeze-thaw plus extrusion (see, e.g., Mayer et al., (1986) *Biochim. Biophys. Acta* 858:161. Microfluidization can be used when consistently small (50 to 200 nm) and relatively uniform aggregates are desired (Mayhew et al., (1984) *Biochim. Biophys. Acta* 775:169. These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al. (1987) *Biochem. Biophys. Res. Commun.,* 147:980-985).

Liposomes, which are pH-sensitive or negatively charged, entrap nucleic acids rather than complex with them. Since both the nucleic acid and the lipid are similarly charged, repulsion rather than complex formation occurs. Nevertheless, some nucleic acid is entrapped within the aqueous interior of these liposomes. pH sensitive liposomes have been used to deliver nucleic acids encoding the thymidine kinase gene to cell monolayers in culture. Expression of the exogenous gene was detected in the target cells (Zhou et al. (1992) *Journal of Controlled Release,* 19:269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid or phosphatidylcholine or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, (1994) *J. Biol. Chem.* 269:2550; Nabel, (1993) *Proc. Natl. Acad. Sci.* 90:11307; Nabel, (1992) *Human Gene Ther.* 3:649; Gershon, (1993) *Biochem.* 32:7143; and Strauss, (1992) *EMBO J.* 11:417.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al., (1994) *S.T.P. Pharma. Sci.,* 4(6):466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., (1987) *FEBS Letters,* 223:42; Wu et al., (1993) *Cancer Research,* 53:3765).

Various liposomes comprising one or more glycolipids are known in the art. Papahadjopoulos et al. (*Ann. N.Y. Acad. Sci.*, (1987), 507:64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, (1988), 85,6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Felgner, P. L. et al., (1987) *Proc. Natl. Acad. Sci. USA* 8:7413-7417, and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Indiana) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wisconsin) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., (1991) *Biochim. Biophys. Res. Commun.* 179:280). Lipopolylysine, made by conjugating polylysine to DOPE, has been reported to be effective for transfection in the presence of serum (Zhou, X. et al., (1991) *Biochim. Biophys. Acta* 1065:8). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, California) and Lipofectamine (DOSPA) (Life Technology, Inc., Gaithersburg, Maryland). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., (1992) *Journal of Drug Targeting*, vol. 2, 405-410 and du Plessis et al., (1992) *Antiviral Research,* 18:259-265; Mannino, R. J. and Fould-Fogerite, S., (1998) *Biotechniques* 6:682-690; Itani, T. et al., (1987) *Gene* 56:267-276; Nicolau, C. et al. (1987) *Meth. Enzymol.* 149:157-176; Straubinger, R. M. and Papahadjopoulos, D. (1983) *Meth. Enzymol.* 101:512-527; Wang, C. Y. and Huang, L., (1987) *Proc. Natl. Acad. Sci. USA* 84:7851-7855).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include RNAi agents can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present disclosure are described in PCT publication No. WO 2008/042973.

Transfersomes, yet another type of liposomes, are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as those described herein, particularly in emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The RNAi agent for use in the methods of the disclosure can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol or m-cresol may be added to the mixed micellar composition to stabilize the formulation and protect against bacterial growth. Alternatively, phenol or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

Lipid Particles

RNAi agents, e.g., dsRNAs of in the disclosure may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in WO 00/03683. The particles of the present disclosure typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present disclosure are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Patent publication No. 2010/0324120 and WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the disclosure.

Certain specific LNP formulations for delivery of RNAi agents have been described in the art, including, e.g., "LNP01" formulations as described in, e.g., WO 2008/042973, which is hereby incorporated by reference.

Additional exemplary lipid-dsRNA formulations are identified in the table below.

| | Ionizable/Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-CDMA (57.1/7.1/34.4/1.4) lipid:siRNA ~ 7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~ 7:1 |

-continued

| | Ionizable/Cationic Lipid | cationic lipid/non-cationic lipid/cholesterol/PEG-lipid conjugate Lipid:siRNA ratio |
|---|---|---|
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~ 6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~ 11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~ 6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~ 11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine

DPPC: dipalmitoylphosphatidylcholine

PEG-DMG: PEG-didimyristoyl glycerol (C14-PEG, or PEG-C14) (PEG with avg mol wt of 2000)

PEG-DSG: PEG-distyryl glycerol (C18-PEG, or PEG-C18) (PEG with avg mol wt of 2000)

PEG-cDMA: PEG-carbamoyl-1,2-dimyristyloxypropylamine (PEG with avg mol wt of 2000)

SNALP (1,2-Dilinolenyloxy-N,N-dimethylaminopropane (DLinDMA)) comprising formulations are described in WO 2009/127060, which is hereby incorporated by reference.

XTC comprising formulations are described in WO 2010/088537, the entire contents of which are hereby incorporated herein by reference.

MC3 comprising formulations are described, e.g., in United States Patent Publication No. 2010/0324120, the entire contents of which are hereby incorporated by reference.

ALNY-100 comprising formulations are described in WO 2010/054406, the entire contents of which are hereby incorporated herein by reference.

C12-200 comprising formulations are described in WO 2010/129709, the entire contents of which are hereby incorporated herein by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the disclosure are administered in conjunction with one or more penetration enhancer surfactants and chelators. Suitable surfactants include fatty acids or esters or salts thereof, bile acids or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the disclosure can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly (ethylcyanoacrylate), poly(butylcyanoacrylate), poly (isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, U.S. 2003/0027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present disclosure include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the brain when treating APP-associated diseases or disorders.

The pharmaceutical formulations of the present disclosure, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present disclosure can be formulated into any of many possible dosage forms such as, but not limited to, tablets, capsules, gel capsules, liquid syrups, soft gels, suppositories, and enemas. The compositions of the present disclosure can also be formulated as suspensions in aqueous, non-aqueous or mixed media. Aqueous suspensions can further contain substances which increase the viscosity of the suspension including, for example, sodium carboxymethylcellulose, sorbitol or dextran. The suspension can also contain stabilizers.

Additional Formulations i. Emulsions

The compositions of the present disclosure can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise, a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present disclosure, the compositions of RNAi agents and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically, microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used, and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or RNAi agents. Microemulsions have also been effective in the transdermal delivery of active components in both cosmetic and pharmaceutical applications. It is expected that the microemulsion compositions and formulations of the present disclosure will facilitate the increased systemic absorption of RNAi agents and nucleic acids from the gastrointestinal tract, as well as improve the local cellular uptake of RNAi agents and nucleic acids.

Microemulsions of the present disclosure can also contain additional components and additives such as sorbitan monostearate (Grill 3), Labrasol, and penetration enhancers to improve the properties of the formulation and to enhance the absorption of the RNAi agents and nucleic acids of the present disclosure. Penetration enhancers used in the microemulsions of the present disclosure can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An RNAi agent of the disclosure may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present disclosure employs various penetration enhancers to effect the efficient delivery of nucleic acids, particularly RNAi agents, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of RNAi agents through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, MA, 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present disclosure, can be defined as compounds that remove metallic ions from solution by forming complexes therewith, with the result that absorption of RNAi agents through the mucosa is enhanced. With regards to their use as penetration enhancers in the present disclosure, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, MA, 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of RNAi agents through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of RNAi agents at the cellular level can also be added to the pharmaceutical and other compositions of the present disclosure. For example, cationic lipids, such as lipofectin (Junichi et al, U.S. Pat. No. 5,705,188), cationic glycerol derivatives, and polycationic molecules, such as polylysine (WO 97/30731), are also known to enhance the cellular uptake of dsRNAs.

Other agents can be utilized to enhance the penetration of the administered nucleic acids, including glycols such as ethylene glycol and propylene glycol, pyrrols such as 2-pyrrol, azones, and terpenes such as limonene and menthone.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc.).

Pharmaceutically acceptable organic or inorganic excipients suitable for non-parenteral administration which do not deleteriously react with nucleic acids can also be used to formulate the compositions of the present disclosure. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present disclosure can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present disclosure, such as dyes, flavoring agents, preservatives, antioxidants, opacifiers, thickening agents and stabilizers. However, such materials, when added, should not unduly interfere with the biological activities of the components of the compositions of the present disclosure. The formulations can be sterilized and, if desired, mixed with auxiliary agents, e.g., lubricants, preservatives, stabilizers, wetting agents, emulsifiers, salts for influencing osmotic pressure, buffers, colorings, flavorings or aromatic substances and the like which do not deleteriously interact with the nucleic acid(s) of the formulation.

Aqueous suspensions can contain substances which increase the viscosity of the suspension including, for example, sodium carboxymethylcellulose, sorbitol or dextran. The suspension can also contain stabilizers.

In some embodiments, pharmaceutical compositions featured in the disclosure include (a) one or more RNAi agents and (b) one or more agents which function by a non-RNAi mechanism and which are useful in treating a C3-associated neurodegenerative disorder. Examples of such agents include, but are not limited to SSRIs, venlafaxine, bupropion, and atypical antipsychotics.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit high therapeutic indices are preferred.

The data obtained from cell culture assays and animal studies can be used in formulating a range of dosage for use in humans. The dosage of compositions featured herein in the disclosure lies generally within a range of circulating concentrations that include the $ED_{50}$ with little or no toxicity. The dosage can vary within this range depending upon the dosage form employed and the route of administration utilized. For any compound used in the methods featured in the disclosure, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the RNAi agents featured in the disclosure can be administered in combination with other known agents effective in treatment of pathological processes mediated by nucleotide repeat expression. In any event, the administering physician can adjust the amount and timing of RNAi agent administration on the basis of results observed using standard measures of efficacy known in the art or described herein.

VI. METHODS FOR INHIBITING C3 EXPRESSION IN AN OCULAR CELL OR A NEURAL CELL

The present invention also provides methods of inhibiting expression of a complement component C3 (C3) in a cell. The methods include contacting a cell with an RNAi agent, e.g., double stranded RNAi agent, in an amount effective to inhibit expression of C3 in the cell, thereby inhibiting expression of C3 in the cell. In certain embodiments of the disclosure, C3 is inhibited preferentially in CNS (e.g., brain) cells. In other embodiments of the disclosure, C3 is inhibited preferentially in the liver (e.g., hepatocytes). In certain embodiments of the disclosure, C3 is inhibited in CNS (e.g., brain) cells and in liver (e.g., hepatocytes) cells. In certain embodiments of the disclosure, C3 is inhibited preferentially in CNS (e.g., brain) cells. In other embodiments of the disclosure, C3 is inhibited preferentially in the eye (e.g., ocular) cells. In certain embodiments of the disclosure, C3 is inhibited in the eye (e.g., ocular) cells and in liver (e.g., hepatocytes) cells.

Contacting of a cell with a RNAi agent, e.g., a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible.

Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a GalNAc ligand, or any other ligand that directs the RNAi agent to a site of interest.

The term "inhibiting," as used herein, is used interchangeably with "reducing," "silencing," "downregulating," "suppressing" and other similar terms, and includes any level of inhibition. In certain embodiments, a level of inhibition, e.g., for an RNAi agent of the instant disclosure, can be assessed in cell culture conditions, e.g., wherein cells in cell culture are transfected via Lipofectamine™-mediated transfection at a concentration in the vicinity of a cell of 10 nM or less, 1 nM or less, etc. Knockdown of a given RNAi agent can be determined via comparison of pre-treated levels in cell culture versus post-treated levels in cell culture, optionally also comparing against cells treated in parallel with a scrambled or other form of control RNAi agent. Knockdown in cell culture of, e.g., 50% or more, can thereby be identified as indicative of "inhibiting" or "reducing", "downregulating" or "suppressing", etc. having occurred. It is expressly contemplated that assessment of targeted mRNA or encoded protein levels (and therefore an extent of "inhibiting", etc. caused by a RNAi agent of the disclosure) can also be assessed in in vivo systems for the RNAi agents of the instant disclosure, under properly controlled conditions as described in the art.

The phrase "inhibiting expression of a C3 gene" or "inhibiting expression of C3," as used herein, includes inhibition of expression of any C3 gene (such as, e.g., a mouse C3 gene, a rat C3 gene, a monkey C3 gene, or a human C3 gene) as well as variants or mutants of a C3 gene that encode a C3 protein. Thus, the C3 gene may be a wild-type C3 gene, a mutant C3 gene, or a transgenic C3 gene in the context of a genetically manipulated cell, group of cells, or organism.

"Inhibiting expression of a C3 gene" includes any level of inhibition of a C3 gene, e.g., at least partial suppression of the expression of a C3 gene, such as an inhibition by at least 20%. In certain embodiments, inhibition is by at least 30%, at least 40%, and in some embodiments at least 50%, at least about 60%, at least 70%, at least about 80%, at least 85%, at least 90%, at least 95%, at least 96%, at least 97%, at least 98%, or at least 99%; or to below the level of detection of the assay method. In a preferred method, inhibition is measured at a 10 nM concentration of the siRNA using the luciferase assay provided in Example 1.

"Inhibiting expression of a C3 gene" includes any level of inhibition of a C3 gene, e.g., at least partial suppression of the expression of a C3 gene.

The expression of the C3 gene may be assessed based on the level, or the change in the level, of any variable associated with C3 gene expression, e.g., C3 mRNA level, C3 protein level.

In some embodiments, the variable associated with C3 gene expression, e.g., C3 mRNA level, C3 protein level is, e.g., extent of thickening of Bruch's membrane (BM), extent of drusen deposits, e.g., sub-RPE basal laminar deposits and basal linear deposits (i.e. drusen), changes in the RPE, e.g., extent of loss of the basal infoldings, atrophy, and hyperplasia, decrease in accumulation of immune cells such as macrophages or microglia, decrease in deposition of activated complement proteins, photoreceptor atrophy, retinal or choroidal neovascularization and fibrosis, decrease in accumulation of lipofuscin in RPE cells with decreased levels of A2E and corresponding decreases in autofluorescence, and/or signals on electroretinograms (ERGs) reflecting decrease in photoreceptor atrophy. This level may be assessed in an individual ocular cell or in a group of ocular cells, including, for example, a sample derived from a subject.

In some embodiments, the variable associated with C3 gene expression, e.g., C3 mRNA level, C3 protein level is, e.g., the level of neuroinflammation, e.g., microglial and astrocyte activation, and C3 deposition in areas of the brain associated with neuronal cell death.

Inhibition may be assessed by a decrease in an absolute or relative level of one or more variables that are associated with C3 expression in the eye compared with a control level. The control level may be any type of control level that is utilized in the art, e.g., a pre-dose baseline level, or a level determined from a similar subject, ocular cell, or sample that is untreated or treated with a control (such as, e.g., buffer only control or inactive agent control).

In some embodiments of the methods of the invention, expression of a C3 gene in an ocular cell is inhibited by at least 20%, at least 25%, at least 30%, at least 35%,at least 40%, at least 45%, and in some embodiments, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least t 98%, at least 99%%, or to below the level of detection of the assay. In some embodiments, the inhibition of expression of a C3 gene results in normalization of the level of the C3 gene such that the difference between the level before treatment and a normal control level is reduced by at least 30%, 35%, 40%, 45%, and in some embodiments at least 50%, 55%, 60%, 65%, 70%, 75%, 80%, 85%, 90%, or 95%. In some embodiments, the inhibition is a clinically relevant inhibition.

In other embodiments of the methods of the invention, expression of a C3 gene in a neural cell is inhibited by at least 20%, at least 25%, at least 30%, at least 35%,at least 40%, at least 45%, and in some embodiments at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least t 98%, at least 99%%, or to below the level of detection of the assay. In some embodiments, the inhibition of expression of a C3 gene results in normalization of the level of the C3 gene such that the difference between the level before treatment and a normal control level is reduced by at least 30%, 35%, 40%, 45%, and, in some embodiments, at least 50%, 55%, 60%, 65%, 70%, 75%, 80%, 85%, 90%, or 95%. In some embodiments, the inhibition is a clinically relevant inhibition.

Inhibition of the expression of a C3 gene may be manifested by a reduction of the amount of mRNA expressed by a first cell or group of ocular cells (such cells may be present, for example, in a sample derived from a subject) in which a C3 gene is transcribed and which has or have been treated (e.g., by contacting the ocular cell or ocular cells with an RNAi agent of the invention, or by administering an RNAi agent of the invention to a subject in which the cells are or were present) such that the expression of a C3 gene is inhibited, as compared to a second cell or group of ocular cells substantially identical to the first cell or group of ocular cells but which has not or have not been so treated (control cell(s)). In preferred embodiments, the inhibition is assessed by expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of a C3 gene may be assessed in terms of a reduction of a parameter that is functionally linked to a C3 gene expression, e.g., C3 protein expression. C3 gene silencing may be determined in any cell expressing C3, either endogenous or heterologous from an expression construct, and by any assay known in the art.

Inhibition of the expression of a C3 protein may be manifested by a reduction in the level of the C3 protein that is expressed by a cell or group of cells (e.g., the level of protein expressed in a sample derived from a subject). As explained above, for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of a C3 gene includes a cell or group of cells that has not yet been contacted with an RNAi agent of the disclosure. For example, the control cell or group of cells may be derived from an individual subject (e.g., a human or animal subject) prior to treatment of the subject with an RNAi agent.

The level of C3 mRNA that is expressed by a cell or group of cells may be determined using any method known in the art for assessing mRNA expression. In one embodiment, the level of expression of C3 in a sample is determined by detecting a transcribed polynucleotide, or portion thereof, e.g., mRNA of the C3 gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. Circulating C3 mRNA may be detected using methods the described in WO2012/177906, the entire contents of which are hereby incorporated herein by reference.

In one embodiment, the level of expression of C3 is determined using a nucleic acid probe. The term "probe", as used herein, refers to any molecule that is capable of selectively binding to a specific C3. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction (PCR) analyses and probe arrays. One method for the determination of mRNA levels involves contacting the isolated mRNA with a nucleic acid molecule (probe) that can hybridize to C3 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of C3 mRNA.

An alternative method for determining the level of expression of C3 in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of C3 is determined by quantitative fluorogenic RT-PCR (i.e., the TaqMan™ System).

The expression levels of C3 mRNA may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of C3 expression level may also comprise using nucleic acid probes in solution.

In preferred embodiments, the level of mRNA expression is assessed using branched DNA (bDNA) assays or real time PCR (qPCR).

The level of C3 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, Western blotting, radioimmunoassay (RIA), enzyme-linked immunosorbent assays (ELISAs), immunofluorescent assays, electrochemiluminescence assays, and the like.

In some embodiments, the efficacy of the methods of the invention can be monitored by detecting or monitoring a reduction in drusen deposit. Reducing drusen deposit, as used herein, includes any decrease in the size, number, or severity of drusen deposits, or to a prevention or reduction in the formation of drusen deposits, within the eye or area of an eye of a subject, as may be assessed in vitro or in vivo using any method known in the art. For example, non-invasive methods of imaging drusen deposits are described in Hunter, A. A. et al (2014) *J Clin Exp Ophthalmol* 5:327, and can be used with computerized assessment. Color fundus photography and fluorescein angiography are useful in determining the presence of number of drusen. OCT scan is capable of producing three-dimensional cross sectional images covering the central macula and providing more quantitative parameters such as area and volume of the deposits. Other methods may include biochemical analyses as well as visual or computerized assessment of vessel network in ocular tissues, e.g. immunohistochemical staining, fluorescent labeling, fluorescence microscopy or other type of microscopy.

In some embodiments, the efficacy of the methods of the invention can be monitored by detecting or monitoring a reduction in neovascularization in the choroid or the retina. Reducing neovascularization, as used herein, includes any decrease in the number or size of new vessel formation, or to a prevention or reduction in the formation of new vessels, within the eye or area of an eye of a subject, as may be assessed in vitro or in vivo using any method known in the art. Methods of assessing neovascularization may include non-invasive retina imaging methods such as color fundus photography and OCT scan. Other methods may include biochemical analyses as well as visual or computerized assessment of vessel network in ocular tissues, e.g. immunohistochemical staining, fluorescent labeling, fluorescence microscopy or other type of microscopy.

In some embodiments, the efficacy of the methods of the disclosure in the treatment of a C3-related disease is assessed by a decrease in C3 mRNA level (e.g., by assessment of a CSF sample for C3 level, by brain biopsy, or otherwise).

In some embodiments, the efficacy of the methods of the disclosure in the treatment of a C3-related disease is assessed by a decrease in C3 mRNA level (e.g., by assessment of a liver sample for C3 level, by biopsy, or otherwise).

In some embodiments of the methods of the disclosure, the RNAi agent is administered to a subject such that the RNAi agent is delivered to a specific site within the subject. The inhibition of expression of C3 may be assessed using measurements of the level or change in the level of C3 mRNA or C3 protein in a sample derived from a specific site within the subject, e.g., CNS cells. In certain embodiments, the methods include a clinically relevant inhibition of expression of C3, e.g. as demonstrated by a clinically relevant outcome after treatment of a subject with an agent to reduce the expression of C3.

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. METHODS FOR TREATING OR PREVENTING A C3-ASSOCIATED OCULAR DISEASE OR A C3-ASSOCIATED NEURODEGENERATIVE DISEASE

The present invention also provides methods for treating or preventing a complement component C3-associated disease, such as a C3-associated ocular disease, or a C3-associated neurodegenerative disease, in a subject. The methods include administering to the subject a therapeutically effective amount or prophylactically effective amount of an RNAi agent of the invention.

The in vivo methods of the disclosure may include administering to a subject a composition containing a RNAi agent, where the RNAi agent includes a nucleotide sequence that is complementary to at least a part of an RNA transcript of the C3 gene of the mammal to be treated. When the organism to be treated is a mammal such as a human, the composition can be administered by any means known in the art including, but not limited to oral, intraperitoneal, or parenteral routes, including intracranial (e.g., intraventricular, intraparenchymal, and intrathecal), intraocular (e.g., periocular, conjunctival, subtenon, intracameral, intravitreal, intraocular, anterior or posterior juxtascleral, subretinal, subconjunctival, retrobulbar, or intracanalicular injection), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intrathecal injection.

In certain embodiments in which the subject to be treated has a C3-associated ocular disease, the RNAi agent of the invention may be administered to the subject intraocularly. In certain embodiments in which the subject to be treated has a C3-associated neurodegenerative disease, the RNAi agent of the invention may be administered to the subject intracranially.

In some embodiments, the administration is via a depot injection. A depot injection may release the RNAi agent in a consistent way over a prolonged time period. Thus, a depot injection may reduce the frequency of dosing needed to obtain a desired effect, e.g., a desired inhibition of C3, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intracranial, intravenous, subcutaneous, arterial, or epidural infusions. In preferred embodiments, the infusion pump is a subcutaneous infusion pump. In other embodiments, the pump is a surgically implanted pump that delivers the RNAi agent to the CNS.

The mode of administration may be chosen based upon whether local or systemic treatment is desired and based upon the area to be treated. The route and site of administration may be chosen to enhance targeting.

In one aspect, the present disclosure also provides methods for inhibiting the expression of a C3 gene in a mammal. The methods include administering to the mammal a composition comprising a dsRNA that targets a C3 gene in a cell of the mammal and maintaining the mammal for a time sufficient to obtain degradation of the mRNA transcript of the C3 gene, thereby inhibiting expression of the C3 gene in the cell. Reduction in gene expression can be assessed by any methods known it the art and by methods, e.g. qRT-PCR, described herein. Reduction in protein production can be assessed by any methods known it the art and by methods, e.g. ELISA, described herein. In one embodiment, a CNS biopsy sample or a cerebrospinal fluid (CSF) sample serves as the tissue material for monitoring the reduction in C3 gene or protein expression (or of a proxy therefore).

The present disclosure further provides methods of preventing, treating or inhibiting the progression of a C3-associated neurodegenerative disease or disorder, such as Alzheimer's disease (AD), Amyotrophic Lateral Sclerosis (ALS), schizophrenia, Parkinson's disease (PD), and prion diseases, such as Creutzfeldt-Jakob disease (CJD).

The methods include intrathecally administering to the subject a therapeutically effective amount of any of the RNAi agent, e.g., dsRNA agents, or the pharmaceutical composition provided herein, thereby preventing, treating, or inhibiting the progression of the C3-associated neurodegenerative disease or disorder in the subject.

The present disclosure also provides methods of preventing, treating or inhibiting the progression of a C3-associated ocular disease or disorder, such as A C3-associated age-related macular degeneration (AMD), C3-associated C3-associated basal laminar drusen (BLD), C3-associated diabetic retinopathy (DR), C3-associated diabetic macular edema (DME) and C3-associated retinal vein occlusion (RVO).

In one aspect, the RNAi agents of the invention are intraocularly administered to subjects suffering from a C3-associated ocular disease, such as aged-related macular degeneration (AMD), basal laminar drusen (BLD), diabetic retinopathy (DR), diabetic macular edema (DME) and retinal vein occlusion (RVO).

Intraocular administration may be via periocular, conjunctival, subtenon, intracameral, intravitreal, intraocular, anterior or posterior juxtascleral, subretinal, subconjunctival, retrobulbar, or intracanalicular injection.

In some embodiments, the RNAi agent is administered to a subject in an amount effective to inhibit C3 expression in an ocular cell, such as an RPE and/or ocular-tissue-resident macrophage cell within the subject. The amount effective to inhibit C3 expression in an ocular cell within a subject may be assessed using methods discussed above, including methods that involve assessment of the inhibition of C3 mRNA, C3 protein, or related variables, such as drusen deposit, neovascularization.

An RNAi agent of the disclosure may be administered as a "free RNAi agent." A free RNAi agent is administered in the absence of a pharmaceutical composition. The naked RNAi agent may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the RNAi agent can be adjusted such that it is suitable for administering to a subject.

Alternatively, an RNAi agent of the disclosure may be administered as a pharmaceutical composition, such as a dsRNA liposomal formulation.

Subjects that would benefit from a reduction or inhibition of C3 gene expression are those having a C3-associated ocular disease or a C3-associated neurodegenerative disease.

The disclosure further provides methods for the use of a RNAi agent or a pharmaceutical composition thereof, e.g., for treating a subject that would benefit from reduction or inhibition of C3 expression, e.g., a subject having a C3-associated disorder, such as a C3-associated ocular disease or a C3-associated neurodegenerative disease, in combination with other pharmaceuticals or other therapeutic methods, e.g., with known pharmaceuticals or known therapeutic methods, such as, for example, those which are currently employed for treating these disorders.

For example, in certain embodiments, an RNAi agent targeting C3 is administered in combination with, e.g., an agent useful in treating a C3-associated neurodegenerative disorder as described elsewhere herein or as otherwise known in the art. For example, additional agents and treatments suitable for treating a subject that would benefit from reduction in C3 expression, e.g., a subject having a C3-associated neurodegenerative disorder, may include agents currently used to treat symptoms of C3. The RNAi agent and additional therapeutic agents may be administered at the same time or in the same combination, e.g., intrathecally, or the additional therapeutic agent can be administered as part of a separate composition or at separate times or by another method known in the art or described herein.

Exemplary additional therapeutics and treatments include, for example, sedatives, antidepressants, clonazepam, sodium valproate, opiates, antiepileptic drugs, cholinesterase inhibitors, memantine, benzodiazepines, levodopa, COMT inhibitors (e.g., tolcapone and entacapone), dopamine agonists (e.g., bromocriptine, pergolide, pramipexole, ropinirole, piribedil, cabergoline, apomorphine and lisuride), MAO-B inhibitors (e.g., safinamide, selegiline and rasagiline), amantadine, an anticholinergic, modafinil, pimavanserin, doxepin, rasagline, an antipsychotic, an atypical antipsychotic (e.g., amisulpride, olanzapine, risperidone, and clozapine), riluzole, edaravone, deep brain stimulation, non-invasive ventilation (NIV), invasive ventilation physical therapy, occupational therapy, speech therapy, dietary changes and swallowing technique a feeding tube, a PEG tube, probiotics, and psychological therapy.

In other embodiments, an RNAi agent targeting C3 is administered in combination with, e.g., an agent useful in treating a C3-associated ocular disorder as described elsewhere herein or as otherwise known in the art. For example, additional agents and treatments suitable for treating a subject that would benefit from reduction in C3 expression, e.g., a subject having a C3-associated ocular disorder, may include agents currently used to treat symptoms of C3. The RNAi agent and additional therapeutic agents may be administered at the same time or in the same combination, e.g., intraocularly, or the additional therapeutic agent can be administered as part of a separate composition or at separate times or by another method known in the art or described herein.

For example, other agents or other therapeutic regimens suitable for treating a C3-associated ocular disease may include anti-VEGF therapy, such as administration of an anti-VEGF antibody, e.g., bevacizumab, brolucizumab, ranibizumab, or administration of recombinant protein inhibitor of VEGF (e.g., aflibercept), a laser treatment, e.g., laser photocoagulation, a corticosteroid for ophthalmologic use (e.g., fluorometholone, dexamethasone, rimexolone, loteprednol, difluprednate, prednisolone, fluocinolone and triamcinolone), insulin, a glucagon-like peptide 1 agonist (e.g., exenatide, liraglutide, dulaglutide, semaglutide, and pramlintide, a sulfonylurea (e.g., chlorpropamide, glipizide), a seglitinide (e.g., repaglinide, nateglinidie), biguanides (e.g., metformin), a thiazolidinedione, e.g., rosiglitazone, troglitazone, an alpha-glucosidase inhibitor (e.g., acarbose and meglitol), an SGLT2 inhibitor (e.g., dapagliflozin), a DPP-4 inhibitor (e.g., linagliptin).

In some aspects, the additional therapeutic agent is an iRNA agent targeting a C5 gene, such as described in PCT Publication Nos WO 2014/160129 and WO 2016/201301, the entire contents of each of which are hereby incorporated herein by reference.

In other aspects, the additional therapeutic agent is an anti-complement component C5 antibody, or antigen-binding fragment thereof (e.g., eculizumab). Eculizumab is a humanized monoclonal IgG2/4, kappa light chain antibody that specifically binds complement component C5 with high affinity and inhibits cleavage of C5 to C5a and C5b, thereby inhibiting the generation of the terminal complement complex C5b-9. Eculizumab is described in U.S. Pat. No. 6,355,245, the entire contents of which are incorporated herein by reference.

In yet other aspects, the additional therapeutic is a C3 peptide inhibitor, or analog thereof. In one embodiment, the C3 peptide inhibitor is compstatin. Compstatin is a cyclic tridecapeptide with potent and selective C3 inhibitory activity. Compstatin, and its analogs, are described in U.S. Pat. Nos. 7,888,323, 7,989,589, and 8,442,776, in U.S. Patent Publication No. 2012/0178694 and 2013/0053302, and in PCT Publication Nos. WO 2012/174055, WO 2012/2178083, WO 2013/036778, the entire contents of each of which are incorporated herein by reference.

In one embodiment, the method includes administering a composition featured herein such that expression of the target C3 gene is decreased, for at least one month. In preferred embodiments, expression is decreased for at least 2 months, or 6 months.

In some embodiments, the RNAi agents useful for the methods and compositions featured herein specifically target RNAs (primary or processed) of the target C3 gene. Compositions and methods for inhibiting the expression of these genes using RNAi agents can be prepared and performed as described herein.

Administration of the dsRNA according to the methods of the disclosure may result in a reduction of the severity, signs, symptoms, or markers of such diseases or disorders in a patient with a C3-associated neurodegenerative disorder. By "reduction" in this context is meant a statistically significant or clinically significant decrease in such level. The reduction can be, for example, at least 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of a C3-associated neurodegenerative disorder may be assessed, for example, by periodic monitoring of a subject's cognition, learning, or memory. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of a RNAi agent targeting C3 or pharmaceutical composition thereof, "effective against" a C3-associated neurodegenerative disorder or a C3-associated ocular disorder indicates that administration in a clinically appropriate manner results in a beneficial effect for at least a statistically significant fraction of patients, such as an improvement of symptoms, a cure, a reduction in disease, extension of life, improvement in quality of life, or other effect generally recognized as positive by medical doctors familiar with treating C3-associated neurodegenerative disorders and the related causes or a C3-associated ocular disorders and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and may be at least 20%, 30%, 40%, 50%, or more can be indicative of effective treatment. Efficacy for a given RNAi agent drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale. Any positive change resulting in e.g., lessening of severity of disease measured using the appropriate scale, represents adequate treatment using a RNAi agent or RNAi agent formulation as described herein.

Subjects can be administered a therapeutic amount of dsRNA, such as about 0.01 mg/kg to about 200 mg/kg.

The RNAi agent can be administered intraocularly, intrathecally, intraventricularly, or by intravenous infusion over a period of time, on a regular basis. In certain embodiments, after an initial treatment regimen, the treatments can be administered on a less frequent basis. Administration of the RNAi agent can reduce C3 levels, e.g., in a cell, tissue, blood, CSF sample or other compartment of the patient by at least 20%, 30%, 40%, 50%, 55%, 60%, 65%, 70,% 75%, 80%, 85%, 90%, 95%, 96%, 97%, 98%, or at least about 99% or more. In a preferred embodiment, administration of the RNAi agent can reduce C3 levels, e.g., in a cell, tissue, blood, CSF sample or other compartment of the patient by at least 50%.

Before administration of a full dose of the RNAi agent, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the RNAi agent can be administered subcutaneously, i.e., by subcutaneous injection. One or more injections may be used to deliver the desired, e.g., monthly dose of RNAi agent to a subject. The injections may be repeated over a period of time. The administration may be repeated on a regular basis. In certain embodiments, after an initial treatment regimen, the treatments can be administered on a less frequent basis. A repeat-dose regimine may include administration of a therapeutic amount of RNAi agent on a regular basis, such as monthly or extending to once a quarter, twice per year, once per year. In certain embodiments, the RNAi agent is administered about once per month to about once per quarter (i.e., about once every three months).

VIII. KITS OF THE INVENTION

The present invention also provides kits for performing any of the methods of the invention. Such kits include one or more RNAi agent(s) and instructions for use, e.g., instructions for inhibiting expression of a C3 in a cell (e.g., ocular cell or neural cell) by contacting the cell with the RNAi agent(s) in an amount effective to inhibit expression of the C3 in the cell. The kits may optionally further comprise means for contacting the cell (e.g., ocular cell or neural cell) with the RNAi agent (e.g., an injection device or an infusion pump), or means for measuring the inhibition of C3 (e.g., means for measuring the inhibition of C3 mRNA or C3 protein). Such means for measuring the inhibition of C3 may comprise a means for obtaining a sample from a subject. The kits of the invention may optionally further comprise means for administering the RNAi agent(s) to a subject or means for determining the therapeutically effective or prophylactically effective amount.

The RNAi agent may be provided in any convenient form, such as a solution in sterile water for injection.

Unless otherwise defined, all technical and scientific terms used herein have the same meaning as commonly understood by one of ordinary skill in the art to which this invention belongs. Although methods and materials similar or equivalent to those described herein can be used in the practice or testing of the RNAi agents and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

An informal Sequence Listing is filed herewith and forms part of the specification as filed.

The invention is further illustrated by the following examples, which should not be construed as further limiting. The contents of all references, pending patent applications and published patents, cited throughout this application are hereby expressly incorporated by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the human complement component C3 (C3) gene (human: NCBI refseqID NM_000064.3; NCBI GeneID: 718) were designed using custom R and Python scripts. The human NM_000064.3 REFSEQ mRNA, has a length of 5148 bases.

Detailed lists of the unmodified complement component sense and antisense strand nucleotide sequences are shown in Tables 2, 4, 6, and 8. Detailed lists of the modified complement component C3 sense and antisense strand nucleotide sequences are shown in Tables 3, 5, 7, and 9.

It is to be understood that, throughout the application, a duplex name without a decimal is equivalent to a duplex name with a decimal which merely references the batch number of the duplex. For example, AD-564727 is equivalent to AD-564727.1.

siRNA Synthesis siRNAs were synthesized and annealed using routine methods known in the art.

Example 2. In Vitro Screening Methods

In Vitro Dual-Luciferase and Endogenous Screening Assays

Cos-7 cells (ATCC, Manassas, VA) are grown to near confluence at 37° C. in an atmosphere of 5% $CO_2$ in DMEM (ATCC) supplemented with 10% FBS, before being released from the plate by trypsinization. Multi-dose experiments are performed at 10 nM and 0.1 nM. siRNA and psiCHECK2-C3 (GenBank Accession No. NM_001028.3) plasmid transfections are carried out with a plasmid containing the 3' untranslated region (UTR). Transfection is carried out by adding 5 μL of siRNA duplexes and 5 μL (5 ng) of psiCHECK2 plasmid per well along with 4.9 μL of Opti-MEM plus 0.1 μL of Lipofectamine 2000 per well (Invitrogen, Carlsbad CA. cat #13778-150) and then incubated at room temperature for 15 minutes. The mixture is then added to the cells which are re-suspended in 35 μL of fresh complete media. The transfected cells are incubated at 37° C. in an atmosphere of 5% $CO_2$.

Forty-eight hours after the siRNAs and psiCHECK2 plasmid are transfected; Firefly (transfection control) and *Renilla* (fused to C3 target sequence) luciferase are measured. First, media is removed from cells. Then Firefly luciferase activity is measured by adding 20 μL of Dual-Glo® Luciferase Reagent equal to the culture medium volume to each well and mix. The mixture is incubated at room temperature for 30 minutes before luminescense (500 nm) is measured on a Spectramax (Molecular Devices) to detect the Firefly luciferase signal. *Renilla* luciferase activity is measured by adding 20 μL of room temperature of Dual-Glo® Stop & Glo® Reagent is added to each well and the plates are incubated for 10-15 minutes before luminescence is again measured to determine the *Renilla* luciferase signal. The Dual-Glo® Stop & Glo® Reagent quenches the firefly luciferase signal and sustained luminescence for the *Renilla* luciferase reaction. siRNA activity is determined by normalizing the *Renilla* (C3) signal to the Firefly (control) signal within each well. The magnitude of siRNA activity is then assessed relative to cells that were transfected with the same vector but were not treated with siRNA or were treated with a non-targeting siRNA. All transfections are done with n=4.

Cell Culture and 384-Well Transfections

Human ARPE-19 cells (ATCC, Manassas, VA) are grown to near confluence at 37° C. in an atmosphere of 5% $CO_2$ in Eagle's Minimum Essential Medium (Gibco) supplemented with 10% FBS (ATCC) before being released from the plate by trypsinization. For mouse cross reactive duplexes, primary mouse retinal pigment epithelial (mRPE) are freshly isolated and grown in DMEM media containing 10% FCS (ATCC) and 100 μg primocin. For both APRE-19 and mRPE, transfection is carried out by adding 14.8 ml of Opti-MEM plus 0.2 ml of Lipofectamine RNAiMax per well (Invitrogen, Carlsbad CA. cat #13778-150) to 5 ml of each siRNA duplex to an individual well in a 96-well plate. The mixture is then incubated at room temperature for 15 minutes. Eighty ml of complete growth media without antibiotic containing ~$2\times10^4$ Hep3B cells or PMH are then added to the siRNA mixture. Cells are incubated for 24 hours prior to RNA purification. Single dose experiments are performed at 10 nM and 0.1 nM final duplex concentration and dose response experiments are done using 8×5-fold serial dilutions over the range of 10 nM to 128 pM.

Total RNA Isolation Using DYNABEADS mRNA Isolation Kit (Invitrogen™, Part #: 610-12)

Cells are lysed in 75 ml of Lysis/Binding Buffer containing 3 μL of beads per well and mixed for 10 minutes on an electrostatic shaker. The washing steps are automated on a Biotek EL406, using a magnetic plate support. Beads are washed (in 90 mL) once in Buffer A, once in Buffer B, and twice in Buffer E, with aspiration steps in between. Following a final aspiration, complete 10 mL RT mixture is added to each well, as described below.

cDNA Synthesis Using ABI High Capacity cDNA Reverse Transcription Kit (Applied Biosystems, Foster City, CA, Cat #4368813)

A master mix of 1 μl 10× Buffer, 0.4 ml 25xdNTPs, 1 ml Random primers, 0.5 ml Reverse Transcriptase, 0.5 ml RNase inhibitor and 6.6 ml of $H_2O$ per reaction are added per well. Plates are sealed, agitated for 10 minutes on an electrostatic shaker, and then incubated at 37 degrees C. for 2 hours. Following this, the plates are agitated at 80 degrees C. for 8 minutes.

Real Time PCR

Two microlitre (μl) of cDNA are added to a master mix containing 0.5 μl of human GAPDH TaqMan Probe (4326317E), 0.5 μl human C3, 2 μl nuclease-free water and 5 μl Lightcycler 480 probe master mix (Roche Cat #04887301001) per well in a 384 well plates (Roche cat #04887301001). Real time PCR is performed in a LightCycler480 Real Time PCR system (Roche).

To calculate relative fold change, data are analyzed using the ΔΔCt method and normalized to assays performed with cells transfected with 10 nM AD-1955, or mock transfected cells. $IC_{50}$s are calculated using a 4 parameter fit model using XLFit and normalized to cells transfected with AD-1955 or mock-transfected.

TABLE 1

| Abbreviations of nucleotide monomers used in nucleic acid sequence representation. It will be understood that these monomers, when present in an oligonucleotide, are mutually linked by 5'-3'-phosphodiester bonds. | |
|---|---|
| Abbreviation | Nucleotide(s) |
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine -3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3' - phosphorothioate |
| c | 2'-O-methylcytidine-3'-phosphate |
| cs | 2'-O-methylcytidine-3' - phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol (Hyp-(GalNAc-alkyl)3) 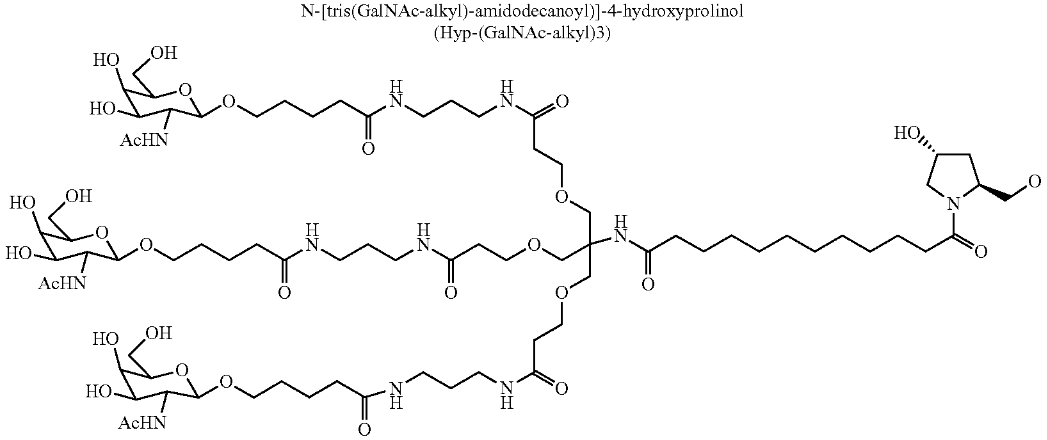 |
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dc | 2'-deoxycytidine-3'-phosphate |

TABLE 1-continued

| Abbreviations of nucleotide monomers used in nucleic acid sequence representation. It will be understood that these monomers, when present in an oligonucleotide, are mutually linked by 5'-3'-phosphodiester bonds. | |
|---|---|
| Abbreviation | Nucleotide(s) |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine-3'-phosphate |
| dTs | 2'-deoxythymidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Chd) | 2'-O-hexadecyl-cytidine-3'-phosphate |
| (Ahd) | 2'-O-hexadecyl-adenosine-3'-phosphate |
| (Ghd) | 2'-O-hexadecyl-guanosine-3'-phosphate |
| (Uhd) | 2'-O-hexadecyl-uridine-3'-phosphate |

TABLE 2

Unmodified Sense and Antisense Strand Sequences of Complement Component C3 dsRNA Agents

| Duplex Name | Sense Sequence 5' to 3' | SEQ ID NO: | Range in NM_000064.3 | Anti-sense Sequence 5' to 3' | SEQ ID NO: | Range in NM_000064.3 |
|---|---|---|---|---|---|---|
| AD-564727.1 | CGGGUACCUCUUCAUCCAGAU | 19 | 474-494 | AUCUGGAUGAAGAGGUACCCGCU | 107 | 472-494 |
| AD-564730.1 | GUACCUCUUCAUCCAGACAGU | 20 | 477-497 | ACUGUCTGGAUGAAGAGGUACCC | 108 | 475-497 |
| AD-564731.1 | UACCUCUUCAUCCAGACAGAU | 21 | 478-498 | AUCUGUCUGGAUGAAGAGGUACC | 109 | 476-498 |
| AD-564739.1 | CAUCCAGACAGACAAGACCAU | 22 | 486-506 | AUGGUCTUGUCUGUCUGGAUGAA | 110 | 484-506 |
| AD-564742.1 | CCAGACAGACAAGACCAUCUU | 23 | 489-509 | AAGAUGGUCUUGUCUGUCUGGAU | 111 | 487-509 |
| AD-564744.1 | AGACAGACAAGACCAUCUACU | 24 | 491-511 | AGUAGATGGUCUUGUCUGUCUGG | 112 | 489-511 |
| AD-564745.1 | GACAGACAAGACCAUCUACAU | 25 | 492-512 | AUGUAGAUGGUCUUGUCUGUCUG | 113 | 490-512 |
| AD-564901.1 | AUUCCGGAACUCGUCAACAUU | 26 | 676-696 | AAUGUUGACGAGUUCCGGAAUGU | 114 | 674-696 |
| AD-564975.1 | CACUGAGUUUGAGGUGAAGGU | 27 | 750-770 | ACCUUCACCUCAAACUCAGUGGA | 115 | 748-770 |
| AD-564976.1 | ACUGAGUUUGAGGUGAAGGAU | 28 | 751-771 | AUCCUUCACCUCAAACUCAGUGG | 116 | 749-771 |
| AD-565005.1 | GCCCAGUUUCGAGGUCAUAGU | 29 | 780-800 | ACUAUGACCUCGAAACUGGGCAG | 117 | 778-800 |
| AD-565040.1 | AAUUCUACUACAUCUAUAACU | 30 | 815-835 | AGUUAUAGAUGUAGUAGAAUUUC | 118 | 813-835 |
| AD-565278.1 | UCCCUACCAGAUCCACUUCAU | 3 | 1146-1166 | AUGAAGTGGAUCUGGUAGGGAGA | 119 | 1144-1166 |
| AD-565279.1 | CCCUACCAGAUCCACUUCACU | 32 | 1147-1167 | AGUGAAGUGGAUCUGGUAGGGAG | 120 | 1145-1167 |
| AD-565281.1 | CUACCAGAUCCACUUCACCAU | 33 | 1149-1169 | AUGGUGAAGUGGAUCUGGUAGGG | 121 | 1147-1169 |
| AD-565282.1 | UACCAGAUCCACUUCACCAAU | 34 | 1150-1170 | AUUGGUGAAGUGGAUCUGGUAGG | 122 | 1148-1170 |
| AD-565284.1 | CCAGAUCCACUUCACCAAGAU | 35 | 1152-1172 | AUCUUGGUGAAGUGGAUCUGGUA | 123 | 1150-1172 |
| AD-565532.1 | GGGCAACUCCAACAAUUACCU | 36 | 1440-1460 | AGGUAATUGUUGGAGUUGCCCAC | 124 | 1438-1460 |
| AD-565534.1 | GCAACUCCAACAAUUACCUGU | 37 | 1442-1462 | ACAGGUAAUUGUUGGAGUUGCCC | 125 | 1440-1462 |
| AD-565535.1 | CAACUCCAACAAUUACCUGCU | 38 | 1443-1463 | AGCAGGTAAUUGUUGGAGUUGCC | 126 | 1441-1463 |
| AD-565541.1 | CAACAAUUACCUGCAUCUCUU | 39 | 1449-1469 | AAGAGATGCAGGUAAUUGUUGGA | 127 | 1447-1469 |
| AD-565616.1 | CAAGAUCCGCUACUACACCUU | 40 | 1548-1568 | AAGGUGTAGUAGCGGAUCUUGGC | 128 | 1546-1568 |
| AD-565904.1 | CGUGCUGAAUAAGAAGAACAU | 41 | 1902-1922 | AUGUUCTUCUUAUUCAGCACGAA | 129 | 1900-1922 |
| AD-565905.1 | GUGCUGAAUAAGAAGAACAAU | 42 | 1903-1923 | AUUGUUCUUCUUAUUCAGCACGA | 130 | 1901-1923 |

TABLE 2-continued

Unmodified Sense and Antisense Strand Sequences of Complement Component C3 dsRNA Agents

| Duplex Name | Sense Sequence 5′ to 3′ | SEQ ID NO: | Range in NM_000064.3 | Anti-sense Sequence 5′ to 3′ | SEQ ID NO: | Range in NM_000064.3 |
|---|---|---|---|---|---|---|
| AD-565925.1 | ACUGACGCAGAGUAAGAUCUU | 43 | 1923-1943 | AAGAUCUUACUCUGCGUCAGUUU | 131 | 1921-1943 |
| AD-566234.1 | UGCAGAAGAGAACAUCGUUUU | 44 | 2361-2381 | AAAACGAUGUUCUCUUCUGCAAU | 132 | 2359-2381 |
| AD-566383.1 | CAUGUCGGACAAGAAAGGGAU | 45 | 2517-2537 | AUCCCUUUCUUGUCCGACAUGCU | 133 | 2515-2537 |
| AD-566384.1 | AUGUCGGACAAGAAAGGGAUU | 46 | 2518-2538 | AAUCCCUUUCUUGUCCGACAUGC | 134 | 2516-2538 |
| AD-566386.1 | GUCGGACAAGAAAGGGAUCUU | 47 | 2520-2540 | AAGAUCCCUUUCUUGUCCGACAU | 135 | 2518-2540 |
| AD-566388.1 | CGGACAAGAAAGGGAUCUGUU | 48 | 2522-2542 | AACAGAUCCCUUUCUUGUCCGAC | 136 | 2520-2542 |
| AD-566409.1 | ACAGUAAUGCAGGACUUCUUU | 49 | 2563-2583 | AAAGAAGUCCUGCAUUACUGUGA | 137 | 2561-2583 |
| AD-566411.1 | AGUAAUGCAGGACUUCUUCAU | 50 | 2565-2585 | AUGAAGAAGUCCUGCAUUACUGU | 138 | 2563-2585 |
| AD-566412.1 | GUAAUGCAGGACUUCUUCAUU | 51 | 2566-2586 | AAUGAAGAAGUCCUGCAUUACUG | 139 | 2564-2586 |
| AD-566442.1 | CUACCCUACUCUGUUGUUCGU | 52 | 2596-2616 | ACGAACAACAGAGUAGGGUAGCC | 140 | 2594-2616 |
| AD-566443.1 | UACCCUACUCUGUUGUUCGAU | 53 | 2597-2617 | AUCGAACAACAGAGUAGGGUAGC | 141 | 2595-2617 |
| AD-566444.1 | ACCCUACUCUGUUGUUCGAAU | 54 | 2598-2618 | AUUCGAACAACAGAGUAGGGUAG | 142 | 2596-2618 |
| AD-566445.1 | CCCUACUCUGUUGUUCGAAAU | 55 | 2599-2619 | AUUUCGAACAACAGAGUAGGGUA | 143 | 2597-2619 |
| AD-566446.1 | CCUACUCUGUUGUUCGAAACU | 56 | 2600-2620 | AGUUUCGAACAACAGAGUAGGGU | 144 | 2598-2620 |
| AD-566447.1 | CUACUCUGUUGUUCGAAACGU | 57 | 2601-2621 | ACGUUUCGAACAACAGAGUAGGG | 145 | 2599-2621 |
| AD-566448.1 | UACUCUGUUGUUCGAAACGAU | 58 | 2602-2622 | AUCGUUTCGAACAACAGAGUAGG | 146 | 2600-2622 |
| AD-566449.1 | ACUCUGUUGUUCGAAACGAGU | 59 | 2603-2623 | ACUCGUUTCGAACAACAGAGUAG | 147 | 2601-2623 |
| AD-566485.1 | CCGUUCUCUACAAUUACCGGU | 60 | 2639-2659 | ACCGGUAAUUGUAGAGAACGGCU | 148 | 2637-2659 |
| AD-566528.1 | GGUGGAACUACUCCACAAUCU | 61 | 2682-2702 | AGAUUGTGGAGUAGUUCCACCCU | 149 | 2680-2702 |
| AD-566837.1 | CCGAGUCUGAGACCAGAAUUU | 62 | 3014-3034 | AAAUUCTGGUCUCAGACUCGGUG | 150 | 3012-3034 |
| AD-566935.1 | GUGCAUUACCUGGAUGAAACU | 63 | 3166-3186 | AGUUUCAUCCAGGUAAUGCACAG | 151 | 3164-3186 |
| AD-567063.1 | CUACGUGGUCAAGGUCUUCUU | 64 | 3333-3353 | AAGAAGACCUUGACCACGUAGGC | 152 | 3331-3353 |
| AD-567066.1 | CGUGGUCAAGGUCUUCUCUCU | 65 | 3336-3356 | AGAGAGAAGACCUUGACCACGUA | 153 | 3334-3356 |
| AD-567067.1 | GUGGUCAAGGUCUUCUCUCUU | 66 | 3337-3357 | AAGAGAGAAGACCUUGACCACGU | 154 | 3335-3357 |
| AD-567156.1 | CGUGAUACACCAAGAAAUGAU | 67 | 3462-3482 | AUCAUUTCUUGGUGUAUCACGGG | 155 | 3460-3482 |
| AD-567215.1 | CGGCCUUUGUUCUCAUCUCGU | 68 | 3524-3544 | ACGAGATGAGAACAAAGGCCGUG | 156 | 3522-3544 |
| AD-567304.1 | GACUUCCUUGAAGCCAACUAU | 69 | 3613-3633 | AUAGUUGGCUUCAAGGAAGUCUC | 157 | 3611-3633 |
| AD-567307.1 | UUCCUUGAAGCCAACUACAUU | 70 | 3616-3636 | AAUGUAGUUGGCUUCAAGGAAGU | 158 | 3614-3636 |
| AD-567314.1 | AAGCCAACUACAUGAACCUAU | 71 | 3623-3643 | AUAGGUTCAUGUAGUUGGCUUCA | 159 | 3621-3643 |
| AD-567315.1 | AGCCAACUACAUGAACCUACU | 72 | 3624-3644 | AGUAGGTUCAUGUAGUUGGCUUC | 160 | 3622-3644 |
| AD-567318.1 | CAACUACAUGAACCUACAGAU | 73 | 3627-3647 | AUCUGUAGGUUCAUGUAGUUGGC | 161 | 3625-3647 |
| AD-567395.1 | UUCUGACCACAGCCAAAGAUU | 74 | 3722-3742 | AAUCUUTGGCUGUGGUCAGAAAU | 162 | 3720-3742 |
| AD-567487.1 | UGCAGCUAAAAGACUUUGACU | 75 | 3815-3835 | AGUCAAAGUCUUUUAGCUGCAGU | 163 | 3813-3835 |
| AD-567521.1 | CGUGCGUUGGCUCAAUGAACU | 76 | 3849-3869 | AGUUCATUGAGCCAACGCACGAC | 164 | 3847-3869 |
| AD-567582.1 | UUCAUGGUGUUCCAAGCCUUU | 77 | 3910-3930 | AAAGGCTUGGAACACCAUGAAGG | 165 | 3908-3930 |
| AD-567699.1 | CUGCGAUCAGAAGAGACCAAU | 78 | 4048-4068 | AUUGGUCUCUUCUGAUCGCAGGA | 166 | 4046-4068 |

TABLE 2-continued

Unmodified Sense and Antisense Strand Sequences of Complement Component C3 dsRNA Agents

| Duplex Name | Sense Sequence 5′ to 3′ | SEQ ID NO: | Range in NM_000064.3 | Anti-sense Sequence 5′ to 3′ | SEQ ID NO: | Range in NM_000064.3 |
|---|---|---|---|---|---|---|
| AD-567700.1 | UGCGAUCAGAAGAGACCAAGU | 79 | 4049-4069 | ACUUGGUCUCUUCUGAUCGCAGG | 167 | 4047-4069 |
| AD-567713.1 | ACCAAGGAAAAUGAGGGUUUU | 80 | 4063-4083 | AAAACCCUCAUUUUCCUUGGUCU | 168 | 4061-4083 |
| AD-567716.1 | AAGGAAAAUGAGGGUUUCACU | 81 | 4066-4086 | AGUGAAACCCUCAUUUUCCUUGG | 169 | 4064-4086 |
| AD-567808.1 | ACUCACCUGUAAUAAAUUCGU | 82 | 4158-4178 | ACGAAUTUAUUACAGGUGAGUUG | 170 | 4156-4178 |
| AD-567809.1 | CUCACCUGUAAUAAAUUCGAU | 83 | 4159-4179 | AUCGAATUUAUUACAGGUGAGUU | 171 | 4157-4179 |
| AD-567812.1 | ACCUGUAAUAAAUUCGACCUU | 84 | 4162-4182 | AAGGUCGAAUUUAUUACAGGUGA | 172 | 4160-4182 |
| AD-567813.1 | CCUGUAAUAAAUUCGACCUCU | 85 | 4163-4183 | AGAGGUCGAAUUUAUUACAGGUG | 173 | 4161-4183 |
| AD-567814.1 | CUGUAAUAAAUUCGACCUCAU | 86 | 4164-4184 | AUGAGGTCGAAUUUAUUACAGGU | 174 | 4162-4184 |
| AD-567828.1 | ACCUCAAGGUCACCAUAAAAU | 87 | 4178-4198 | AUUUUATGGUGACCUUGAGGUCG | 175 | 4176-4198 |
| AD-567829.1 | CCUCAAGGUCACCAUAAAACU | 88 | 4179-4199 | AGUUUUAUGGUGACCUUGAGGUC | 176 | 4177-4199 |
| AD-567831.1 | UCAAGGUCACCAUAAAACCAU | 89 | 4181-4201 | AUGGUUTUAUGGUGACCUUGAGG | 177 | 4179-4201 |
| AD-568003.1 | CAGAUACAUCUCCAAGUAUGU | 90 | 4371-4391 | ACAUACTUGGAGAUGUAUCUGUC | 178 | 4369-4391 |
| AD-568026.1 | UGGACAAAGCCUUCUCCGAUU | 91 | 4394-4414 | AAUCGGAGAAGGCUUUGUCCAGC | 179 | 4392-4414 |
| AD-568099.1 | UCUAGCUUUCAAAGUUCACCU | 92 | 4467-4487 | AGGUGAACUUUGAAAGCUAGACA | 180 | 4465-4487 |
| AD-568100.1 | CUAGCUUUCAAAGUUCACCAU | 93 | 4468-4488 | AUGGUGAACUUUGAAAGCUAGAC | 181 | 4466-4488 |
| AD-568153.1 | AGUCAAGGUCUACGCCUAUUU | 4 | 4521-4541 | AAAUAGGCGUAGACCUUGACUGC | 182 | 4519-4541 |
| AD-568156.1 | CAAGGUCUACGCCUAUUACAU | 95 | 4524-4544 | AUGUAATAGGCGUAGACCUUGAC | 183 | 4522-4544 |
| AD-568157.1 | AAGGUCUACGCCUAUUACAAU | 96 | 4525-4545 | AUUGUAAUAGGCGUAGACCUUGA | 184 | 4523-4545 |
| AD-568158.1 | AGGUCUACGCCUAUUACAACU | 97 | 4526-4546 | AGUUGUAAUAGGCGUAGACCUUG | 185 | 4524-4546 |
| AD-568160.1 | GUCUACGCCUAUUACAACCUU | 98 | 4528-4548 | AAGGUUGUAAUAGGCGUAGACCU | 186 | 4526-4548 |
| AD-568161.1 | UCUACGCCUAUUACAACCUGU | 99 | 4529-4549 | ACAGGUTGUAAUAGGCGUAGACC | 187 | 4527-4549 |
| AD-568341.1 | GGAGUGGACUAUGUGUACAAU | 100 | 4711-4731 | AUUGUACACAUAGUCCACUCCUG | 188 | 4709-4731 |
| AD-568343.1 | AGUGGACUAUGUGUACAAGAU | 101 | 4713-4733 | AUCUUGTACACAUAGUCCACUCC | 189 | 4711-4733 |
| AD-568344.1 | GUGGACUAUGUGUACAAGACU | 102 | 4714-4734 | AGUCUUGUACACAUAGUCCACUC | 190 | 4712-4734 |
| AD-568345.1 | UGGACUAUGUGUACAAGACCU | 103 | 4715-4735 | AGGUCUTGUACACAUAGUCCACU | 191 | 4713-4735 |
| AD-568381.1 | AGCUGUCCAAUGACUUUGACU | 104 | 4751-4771 | AGUCAAAGUCAUUGGACAGCUGA | 192 | 4749-4771 |
| AD-568382.1 | GCUGUCCAAUGACUUUGACGU | 105 | 4752-4772 | ACGUCAAAGUCAUUGGACAGCUG | 193 | 4750-4772 |
| AD-568586.1 | GAGAACCAGAAACAAUGCCAU | 106 | 5014-5034 | AUGGCATUGUUUCUGGUUCUCUU | 194 | 5012-5034 |

TABLE 3

Modified Sense and Antisense Strand Sequences of Complement Component C3 dsRNA Agents

| Duplex Name | Sense Sequence 5′ to 3′ | SEQ ID NO: | Antisense Sequence 5′ to 3′ | SEQ ID NO: | mRNA target sequence | SEQ ID NO: |
|---|---|---|---|---|---|---|
| AD-564727.1 | csgsgguaCfcUfCfUfucauccagau | 195 | asUfscugg(Agn)ugaagaGfgUfacccgscsu | 283 | AGCGGGUACCUCUUCAUCCAGAC | 371 |

TABLE 3-continued

Modified Sense and Antisense Strand Sequences of Complement Component C3 dsRNA Agents

| Duplex Name | Sense Sequence 5′ to 3′ | SEQ ID NO: | Antisense Sequence 5′ to 3′ | SEQ ID NO: | mRNA target sequence | SEQ ID NO: |
|---|---|---|---|---|---|---|
| AD-564730.1 | gsusaccuCfuUfCfAfuccagacagu | 196 | asCfsuguc(Tgn)ggaugaAfgAfgguacscsc | 284 | GGGUACCUCUUCAUCCAGACAGA | 372 |
| AD-564731.1 | usasccucUfuCfAfUfccagacagau | 197 | asUfscugu(Cgn)uggaugAfaGfagguascsc | 285 | GGUACCUCUUCAUCCAGACAGAC | 373 |
| AD-564739.1 | csasuccaGfaCfAfGfacaagaccau | 198 | asUfsgguc(Tgn)ugucugUfcUfggaugsasa | 286 | UUCAUCCAGACAGACAAGACCAU | 374 |
| AD-564742.1 | cscsagacAfgAfCfAfagaccaucuu | 199 | asAfsgaug(Ggn)ucuuguCfuGfucuggsasu | 287 | AUCCAGACAGACAAGACCAUCUA | 375 |
| AD-564744.1 | asgsacagAfcAfAfGfaccaucuacu | 200 | asGfsuaga(Tgn)ggucuuGfuCfugucusgsg | 288 | CCAGACAGACAAGACCAUCUACA | 376 |
| AD-564745.1 | gsascagaCfaAfGfAfccaucuacau | 201 | asUfsguag(Agn)uggucuUfgUfcugucsusg | 289 | CAGACAGACAAGACCAUCUACAC | 377 |
| AD-564901.1 | asusuccgGfaAfCfUfcgucaacauu | 202 | asAfsuguu(Ggn)acgaguUfcCfggaausgsu | 290 | ACAUUCCGGAACUCGUCAACAUG | 378 |
| AD-564975.1 | csascugaGfuUfUfGfaggugaaggu | 203 | asCfscuuc(Agn)ccucaaAfcUfcagugsgsa | 291 | UCCACUGAGUUUGAGGUGAAGGA | 379 |
| AD-564976.1 | ascsugagUfuUfGfAfggugaaggau | 204 | asUfsccuu(Cgn)accucaAfaCfucagusgsg | 292 | CCACUGAGUUUGAGGUGAAGGAG | 380 |
| AD-565005.1 | gscsccagUfuUfCfGfaggucauagu | 205 | asCfsuaug(Agn)ccucgaAfaCfugggcsasg | 293 | CUGCCCAGUUUCGAGGUCAUAGU | 381 |
| AD-565040.1 | asasuucuAfcUfAfCfaucuauaacu | 206 | asGfsuuau(Agn)gauguaGfuAfgaauusus c | 294 | GAAAUUCUACUACAUCUAUAACG | 382 |
| AD-565278.1 | uscsccuaCfcAfGfAfuccacuucau | 207 | asUfsgaag(Tgn)ggaucuGfgUfagggasgsa | 295 | UCUCCCUACCAGAUCCACUUCAC | 383 |
| AD-565279.1 | cscscuacCfaGfAfUfccacuucacu | 208 | asGfsugaa(Ggn)uggaucUfgGfuagggsasg | 296 | CUCCCUACCAGAUCCACUUCACC | 384 |
| AD-565281.1 | csusaccaGfaUfCfCfacuucaccau | 209 | asUfsggug(Agn)aguggaUfcUfgguagsgsg | 297 | CCCUACCAGAUCCACUUCACCAA | 385 |
| AD-565282.1 | usasccagAfuCfCfAfcuucaccaau | 210 | asUfsuggu(Ggn)aaguggAfuCfugguasgsg | 298 | CCUACCAGAUCCACUUCACCAAG | 386 |
| AD-565284.1 | cscsagauCfcAfCfUfucaccaagau | 211 | asUfscuug(Ggn)ugaaguGfgAfucuggsusa | 299 | UACCAGAUCCACUUCACCAAGAC | 387 |
| AD-565532.1 | gsgsgcaaCfuCfCfAfacaauuaccu | 212 | asGfsguaa(Tgn)uguuggAfgUfugcccsasc | 300 | GUGGGCAACUCCAACAAUUACCU | 388 |
| AD-565534.1 | gscsaacuCfcAfAfCfaauuaccugu | 213 | asCfsaggu(Agn)auuguuGfgAfguugcscsc | 301 | GGGCAACUCCAACAAUUACCUGC | 389 |

TABLE 3-continued

Modified Sense and Antisense Strand Sequences of Complement Component C3 dsRNA Agents

| Duplex Name | Sense Sequence 5′ to 3′ | SEQ ID NO: | Antisense Sequence 5′ to 3′ | SEQ ID NO: | mRNA target sequence | SEQ ID NO: |
|---|---|---|---|---|---|---|
| AD-565535.1 | csasacucCfaAfCfAfauuaccugcu | 214 | asGfscagg(Tgn)aauuguUfgGfaguugscsc | 302 | GGCAACUCCAACAAUUACCUGCA | 390 |
| AD-565541.1 | csasacaaUfuAfCfCfugcaucucuu | 215 | asAfsgaga(Tgn)gcagguAfaUfuguugsgsa | 303 | UCCAACAAUUACCUGCAUCUCUC | 391 |
| AD-565616.1 | csasagauCfcGfCfUfacuacaccuu | 216 | asAfsggug(Tgn)aguagcGfgAfucuugsgsc | 304 | GCCAAGAUCCGCUACUACACCUA | 392 |
| AD-565904.1 | csgsugcuGfaAfUfAfagaagaacau | 217 | asUfsguuc(Tgn)ucuuauUfcAfgcacgsasa | 305 | UUCGUGCUGAAUAAGAAGAACAA | 393 |
| AD-565905.1 | gsusgcugAfaUfAfAfgaagaacaau | 218 | asUfsuguu(Cgn)uucuuaUfuCfagcacsgsa | 306 | UCGUGCUGAAUAAGAAGAACAAA | 394 |
| AD-565925.1 | ascsugacGfcAfGfAfguaagaucuu | 219 | asAfsgauc(Tgn)uacucuGfcGfucagususu | 307 | AAACUGACGCAGAGUAAGAUCUG | 395 |
| AD-566234.1 | usgscagaAfgAfGfAfacaucguuuu | 220 | asAfsaacg(Agn)uguucuCfuUfcugcasasu | 308 | AUUGCAGAAGAGAACAUCGUUUC | 396 |
| AD-566383.1 | csasugucGfgAfCfAfagaaagggau | 221 | asUfscccu(Tgn)ucuuguCfcGfacaugscsu | 309 | AGCAUGUCGGACAAGAAAGGGAU | 397 |
| AD-566384.1 | asusgucgGfaCfAfAfgaaagggauu | 222 | asAfsuccc(Tgn)uucuugUfcCfgacausgsc | 310 | GCAUGUCGGACAAGAAAGGGAUC | 398 |
| AD-566386.1 | gsuscggaCfaAfGfAfaagggaucuu | 223 | asAfsgauc(Cgn)cuuucuUfgUfccgacsasu | 311 | AUGUCGGACAAGAAAGGGAUCUG | 399 |
| AD-566388.1 | csgsgacaAfgAfAfAfgggaucuguu | 224 | asAfscaga(Tgn)cccuuuCfuUfguccgsasc | 312 | GUCGGACAAGAAAGGGAUCUGUG | 400 |
| AD-566409.1 | ascsaguaAfuGfCfAfggacuucuuu | 225 | asAfsagaa(Ggn)uccugcAfuUfacugusgsa | 313 | UCACAGUAAUGCAGGACUUCUUC | 401 |
| AD-566411.1 | asgsuaauGfcAfGfGfacuucuucau | 226 | asUfsgaag(Agn)aguccuGfcAfuuacusgsu | 314 | ACAGUAAUGCAGGACUUCUUCAU | 402 |
| AD-566412.1 | gsusaaugCfaGfGfAfcuucuucauu | 227 | asAfsugaa(Ggn)aaguccUfgCfauuacsusg | 315 | CAGUAAUGCAGGACUUCUUCAUC | 403 |
| AD-566442.1 | csusacccUfaCfUfCfuguuguucgu | 228 | asCfsgaac(Agn)acagagUfaGfgguagscsc | 316 | GGCUACCCUACUCUGUUGUUCGA | 404 |
| AD-566443.1 | usascccuAfcUfCfUfguuguucgau | 229 | asUfscgaa(Cgn)aacagaGfuAfggguasgsc | 317 | GCUACCCUACUCUGUUGUUCGAA | 405 |
| AD-566444.1 | ascsccuaCfuCfUfGfuuguucgaau | 230 | asUfsucga(Agn)caacagAfgUfagggusasg | 318 | CUACCCUACUCUGUUGUUCGAAA | 406 |
| AD-566445.1 | cscscuacUfcUfGfUfuguucgaaau | 231 | asUfsuucg(Agn)acaacaGfaGfuagggsusa | 319 | UACCCUACUCUGUUGUUCGAAAC | 407 |

TABLE 3-continued

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-566446.1 | cscsuacuCfuGfUfUfguucgaaacu | 232 | asGfsuuuc(Ggn)aacaacAfgAfguaggsgsu | 320 | ACCCUACUCUGUUGUUCGAAACG | 408 |
| AD-566447.1 | csusacucUfgUfUfGfuucgaaacgu | 233 | asCfsguuu(Cgn)gaacaaCfaGfaguagsgsg | 321 | CCCUACUCUGUUGUUCGAAACGA | 409 |
| AD-566448.1 | usascucuGfuUfGfUfucgaaacgau | 234 | asUfscguu(Tgn)cgaacaAfcAfgaguasgsg | 322 | CCUACUCUGUUGUUCGAAACGAG | 410 |
| AD-566449.1 | ascsucugUfuGfUfUfcgaaacgagu | 235 | asCfsucgu(Tgn)ucgaacAfaCfagagusasg | 323 | CUACUCUGUUGUUCGAAACGAGC | 411 |
| AD-566485.1 | cscsguucUfcUfAfCfaauuaccggu | 236 | asCfscggu(Agn)auuguaGfaGfaacggscsu | 324 | AGCCGUUCUCUACAAUUACCGGC | 412 |
| AD-566528.1 | gsgsuggaAfcUfAfCfuccacaaucu | 237 | asGfsauug(Tgn)ggaguaGfuUfccaccscsu | 325 | AGGGUGGAACUACUCCACAAUCC | 413 |
| AD-566837.1 | cscsgaguCfuGfAfGfaccagaauuu | 238 | asAfsauuc(Tgn)ggucucAfgAfcucggsusg | 326 | CACCGAGUCUGAGACCAGAAUUC | 414 |
| AD-566935.1 | gsusgcauUfaCfCfUfggaugaaacu | 239 | asGfsuuuc(Agn)uccaggUfaAfugcacsasg | 327 | CUGUGCAUUACCUGGAUGAAACG | 415 |
| AD-567063.1 | csusacguGfgUfCfAfaggucuucuu | 240 | asAfsgaag(Agn)ccuugaCfcAfcguagsgsc | 328 | GCCUACGUGGUCAAGGUCUUCUC | 416 |
| AD-567066.1 | csgsugguCfaAfGfGfucuucucucu | 241 | asGfsagag(Agn)agaccuUfgAfccacgsusa | 329 | UACGUGGUCAAGGUCUUCUCUCU | 417 |
| AD-567067.1 | gsusggucAfaGfGfUfcuucucucuu | 242 | asAfsgaga(Ggn)aagaccUfuGfaccacgsgsu | 330 | ACGUGGUCAAGGUCUUCUCUCUG | 418 |
| AD-567156.1 | csgsugauAfcAfCfCfaagaaaugau | 243 | asUfscauu(Tgn)cuugguGfuAfucacgsgsg | 331 | CCCGUGAUACACCAAGAAAUGAU | 419 |
| AD-567215.1 | csgsgccuUfuGfUfUfcucaucucgu | 244 | asCfsgaga(Tgn)gagaacAfaAfggccgsusg | 332 | CACGGCCUUUGUUCUCAUCUCGC | 420 |
| AD-567304.1 | gsascuucCfuUfGfAfagccaacuau | 245 | asUfsaguu(Ggn)gcuucaAfgGfaagucsusc | 333 | GAGACUUCCUUGAAGCCAACUAC | 421 |
| AD-567307.1 | ususccuuGfaAfGfCfcaacuacauu | 246 | asAfsugua(Ggn)uuggcuUfcAfaggaasgsu | 334 | ACUUCCUUGAAGCCAACUACAUG | 422 |
| AD-567314.1 | asasgccaAfcUfAfCfaugaaccuau | 247 | asUfsaggu(Tgn)cauguaGfuUfggcuuscsa | 335 | UGAAGCCAACUACAUGAACCUAC | 423 |
| AD-567315.1 | asgsccaaCfuAfCfAfugaaccuacu | 248 | asGfsuagg(Tgn)ucauguAfgUfuggcususc | 336 | GAAGCCAACUACAUGAACCUACA | 424 |
| AD-567318.1 | csasacuaCfaUfGfAfaccuacagau | 249 | asUfscugu(Agn)gguucaUfgUfaguugsgsc | 337 | GCCAACUACAUGAACCUACAGAG | 425 |

TABLE 3-continued

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-567395.1 | ususcugaCfcAfCfAfgccaaagauu | 250 | asAfsucuu(Tgn)ggcuguGfgUfcagaasasu | 338 | AUUUCUGACCACAGCCAAAGAUA | 426 |
| AD-567487.1 | usgscagcUfaAfAfAfgacuuugacu | 251 | asGfsucaa(Agn)gucuuuUfaGfcugcasgsu | 339 | ACUGCAGCUAAAAGACUUUGACU | 427 |
| AD-567521.1 | csgsugcgUfuGfGfCfucaaugaacu | 252 | asGfsuuca(Tgn)ugagccAfaCfgcacgsasc | 340 | GUCGUGCGUUGGCUCAAUGAACA | 428 |
| AD-567582.1 | ususcaugGfuGfUfUfccaagccuuu | 253 | asAfsaggc(Tgn)uggaacAfcCfaugaasgsg | 341 | CCUUCAUGGUGUUCCAAGCCUUG | 429 |
| AD-567699.1 | csusgcgaUfcAfGfAfagagaccaau | 254 | asUfsuggu(Cgn)ucuucuGfaUfcgcagsgsa | 342 | UCCUGCGAUCAGAAGAGACCAAG | 430 |
| AD-567700.1 | usgscgauCfaGfAfAfgagaccaagu | 255 | asCfsuugg(Tgn)cucuucUfgAfucgcasgsg | 343 | CCUGCGAUCAGAAGAGACCAAGG | 431 |
| AD-567713.1 | ascscaagGfaAfAfAfugaggguuuu | 256 | asAfsaacc(Cgn)ucauuuUfcCfuugguscsu | 344 | AGACCAAGGAAAAUGAGGGUUUC | 432 |
| AD-567716.1 | asasggaaAfaUfGfAfggguuucacu | 257 | asGfsugaa(Agn)cccucaUfuUfuccuusgsg | 345 | CCAAGGAAAAUGAGGGUUUCACA | 433 |
| AD-567808.1 | ascsucacCfuGfUfAfauaaauucgu | 258 | asCfsgaau(Tgn)uauuacAfgGfugagusgsg | 346 | CAACUCACCUGUAAUAAAUUCGA | 434 |
| AD-567809.1 | csuscaccUfgUfAfAfuaaauucgau | 259 | asUfscgaa(Tgn)uuauuaCfaGfgugagsusu | 347 | AACUCACCUGUAAUAAAUUCGAC | 435 |
| AD-567812.1 | ascscuguAfaUfAfAfauucgaccuu | 260 | asAfsgguc(Ggn)aauuuaUfuAfcaggusgsa | 348 | UCACCUGUAAUAAAUUCGACCUC | 436 |
| AD-567813.1 | cscsuguaAfuAfAfAfuucgaccucu | 261 | asGfsaggu(Cgn)gaauuuAfuUfacaggsusg | 349 | CACCUGUAAUAAAUUCGACCUCA | 437 |
| AD-567814.1 | csusguaaUfaAfAfUfucgaccucau | 262 | asUfsgagg(Tgn)cgaauuUfaUfuacagsgsu | 350 | ACCUGUAAUAAAUUCGACCUCAA | 438 |
| AD-567828.1 | ascscucaAfgGfUfCfaccauaaaau | 263 | asUfsuuua(Tgn)ggugacCfuUfgaggucsg | 351 | CGACCUCAAGGUCACCAUAAAAC | 439 |
| AD-567829.1 | cscsucaaGfgUfCfAfccauaaaacu | 264 | asGfsuuuu(Agn)uggugaCfcUfugaggsusc | 352 | GACCUCAAGGUCACCAUAAAACC | 440 |
| AD-567831.1 | uscsaaggUfcAfCfCfauaaaaccau | 265 | asUfsgguu(Tgn)uaugguGfaCfcuugasgsg | 353 | CCUCAAGGUCACCAUAAAACCAG | 441 |
| AD-568003.1 | csasgauaCfaUfCfUfccaaguaugu | 266 | asCfsauac(Tgn)uggagaUfgUfaucugsusc | 354 | GACAGAUACAUCUCCAAGUAUGA | 442 |
| AD-568026.1 | usgsgacaAfaGfCfCfuucuccgauu | 267 | asAfsucgg(Agn)gaaggcUfuUfguccasgsc | 355 | GCUGGACAAAGCCUUCUCCGAUA | 443 |

TABLE 3-continued

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-568099.1 | uscsuagcUfuUfCfAfaaguucaccu | 268 | asGfsguga(Agn)cuuugaAfaGfcuagascsa | 356 | UGUCUAGCUUUCAAAGUUCACCA | 444 |
| AD-568100.1 | csusagcuUfuCfAfAfaguucaccau | 269 | asUfsggug(Agn)acuuugAfaAfgcuagsasc | 357 | GUCUAGCUUUCAAAGUUCACCAA | 445 |
| AD-568153.1 | asgsucaaGfgUfCfUfacgccuauuu | 270 | asAfsauag(Ggn)cguagaCfcUfugacusgsc | 358 | GCAGUCAAGGUCUACGCCUAUUA | 446 |
| AD-568156.1 | csasagguCfuAfCfGfccuauuacau | 271 | asUfsguaa(Tgn)aggcguAfgAfccuugsasc | 359 | GUCAAGGUCUACGCCUAUUACAA | 447 |
| AD-568157.1 | asasggucUfaCfGfCfcuauuacaau | 272 | asUfsugua(Agn)uaggcgUfaGfaccuusgsa | 360 | UCAAGGUCUACGCCUAUUACAAC | 448 |
| AD-568158.1 | asgsgucuAfcGfCfCfuauuacaacu | 273 | asGfsuugu(Agn)auaggcGfuAfgaccusg | 361 | CAAGGUCUACGCCUAUUACAACC | 449 |
| AD-568160.1 | gsuscuacGfcCfUfAfuuacaaccuu | 274 | asAfsgguu(Ggn)uaauagGfcGfuagacscsu | 362 | AGGUCUACGCCUAUUACAACCUG | 450 |
| AD-568161.1 | uscsuacgCfcUfAfUfuacaaccugu | 275 | asCfsaggu(Tgn)guaauaGfgCfguagascsc | 363 | GGUCUACGCCUAUUACAACCUGG | 451 |
| AD-568341.1 | gsgsagugGfaCfUfAfuguguacaau | 276 | asUfsugua(Cgn)acauagUfcCfacuccsusg | 364 | CAGGAGUGGACUAUGUGUACAAG | 452 |
| AD-568343.1 | asgsuggaCfuAfUfGfuguacaagau | 277 | asUfscuug(Tgn)acacauAfgUfccacuscsc | 365 | GGAGUGGACUAUGUGUACAAGAC | 453 |
| AD-568344.1 | gsusggacUfaUfGfUfguacaagacu | 278 | asGfsucuu(Ggn)uacacaUfaGfuccacsusc | 366 | GAGUGGACUAUGUGUACAAGACC | 454 |
| AD-568345.1 | usgsgacuAfuGfUfGfuacaagaccu | 279 | asGfsgucu(Tgn)guacacAfuAfguccascsu | 367 | AGUGGACUAUGUGUACAAGACCC | 455 |
| AD-568381.1 | asgscuguCfcAfAfUfgacuuugacu | 280 | asGfsucaa(Agn)gucauuGfgAfcagcusgsa | 368 | UCAGCUGUCCAAUGACUUUGACG | 456 |
| AD-568382.1 | gscsugucCfaAfUfGfacuuugacgu | 281 | asCfsguca(Agn)agucauUfgGfacagcsusg | 369 | CAGCUGUCCAAUGACUUUGACGA | 457 |
| AD-568586.1 | gsasgaacCfaGfAfAfcaaugccau | 282 | asUfsggca(Tgn)uguuucUfgGfuucucsusu | 370 | AAGAGAACCAGAAACAAUGCCAG | 458 |

TABLE 4

Unmodified Sense and Antisense Strand Sequences of Complement Component C3 dsRNA Agents

| Duplex Name | Sense Sequence 5' to 3' | SEQ ID NO: | Range in NM_000064.3 | Antisense Sequence 5' to 3' | SEQ ID NO: | Range in NM_000064.3 |
|---|---|---|---|---|---|---|
| AD-569034.1 | ACGGUCAUGGUCAACAUUGAU | 459 | 577-597 | AUCAAUGUUGACCAUGACCGUCC | 483 | 575-597 |
| AD-569164.1 | AGAUCCGAGCCUACUAUGAAU | 460 | 707-727 | AUUCAUAGUAGGCUCGGAUCUUC | 484 | 705-727 |
| AD-569165.1 | GAUCCGAGCCUACUAUGAAAU | 461 | 708-728 | AUUUCAUAGUAGGCUCGGAUCUU | 485 | 706-728 |
| AD-569272.1 | AAUUCUACUACAUCUAUAACU | 30 | 815-835 | AGUUAUAGAUGUAGUAGAAUUUC | 118 | 813-835 |
| AD-569763.1 | UGGGCAACUCCAACAAUUACU | 462 | 1439-1459 | AGUAAUUGUUGGAGUUGCCCACG | 486 | 1437-1459 |
| AD-569765.1 | GGCAACUCCAACAAUUACCUU | 463 | 1441-1461 | AAGGUAAUUGUUGGAGUUGCCCA | 487 | 1439-1461 |
| AD-570130.1 | CGUGUUCGUGCUGAAUAAGAU | 464 | 1896-1916 | AUCUUAUUCAGCACGAACACGCC | 488 | 1894-1916 |
| AD-570132.1 | UGUUCGUGCUGAAUAAGAAGU | 465 | 1898-1918 | ACUUCUUAUUCAGCACGAACACG | 489 | 1896-1918 |
| AD-570133.1 | GUUCGUGCUGAAUAAGAAGAU | 466 | 1899-1919 | AUCUUCUUAUUCAGCACGAACAC | 490 | 1897-1919 |
| AD-570134.1 | UUCGUGCUGAAUAAGAAGAAU | 467 | 1900-1920 | AUUCUUCUUAUUCAGCACGAACA | 491 | 1898-1920 |
| AD-570157.1 | ACUGACGCAGAGUAAGAUCUU | 43 | 1923-1943 | AAGAUCUUACUCUGCGUCAGUUU | 492 | 1921-1943 |
| AD-570711.1 | UCCGAGCCGUUCUCUACAAUU | 468 | 2633-2653 | AAUUGUAGAGAACGGCUCGGAUU | 493 | 2631-2653 |
| AD-570712.1 | CCGAGCCGUUCUCUACAAUUU | 469 | 2634-2654 | AAAUUGUAGAGAACGGCUCGGAU | 494 | 2632-2654 |
| AD-570713.1 | CGAGCCGUUCUCUACAAUUAU | 470 | 2635-2655 | AUAAUUGUAGAGAACGGCUCGGA | 495 | 2633-2655 |
| AD-570714.1 | GAGCCGUUCUCUACAAUUACU | 471 | 2636-2656 | AGUAAUUGUAGAGAACGGCUCGG | 496 | 2634-2656 |
| AD-571539.1 | UUCCUUGAAGCCAACUACAUU | 70 | 3616-3636 | AAUGUAGUUGGCUUCAAGGAAGU | 158 | 3614-3636 |
| AD-571610.1 | GCCUCUUCUUAACAAAUUUCU | 472 | 3705-3725 | AGAAAUUUGUUAAGAAGAGGCCC | 497 | 3703-3725 |
| AD-571633.1 | CCACAGCCAAAGAUAAGAACU | 473 | 3728-3748 | AGUUCUUAUCUUUGGCUGUGGUC | 498 | 3726-3748 |
| AD-571715.1 | CUACUGCAGCUAAAAGACUUU | 474 | 3811-3831 | AAAGUCUUUUAGCUGCAGUAGGG | 499 | 3809-3831 |
| AD-571752.1 | UCGUGCGUUGGCUCAAUGAAU | 475 | 3848-3868 | AUUCAUUGAGCCAACGCACGACG | 500 | 3846-3868 |
| AD-571754.1 | GUGCGUUGGCUCAAUGAACAU | 476 | 3850-3870 | AUGUUCAUUGAGCCAACGCACGA | 501 | 3848-3870 |
| AD-571828.1 | AGCCUUGGCUCAAUACCAAAU | 477 | 3924-3944 | AUUUGGUAUUGAGCCAAGGCUUG | 502 | 3922-3944 |
| AD-572039.1 | AACUCACCUGUAAUAAAUUCU | 478 | 4157-4177 | AGAAUUUAUUACAGGUGAGUUGA | 503 | 4155-4177 |
| AD-572040.1 | ACUCACCUGUAAUAAAUUCGU | 82 | 4158-4178 | ACGAAUUUAUUACAGGUGAGUUG | 504 | 4156-4178 |
| AD-572041.1 | CUCACCUGUAAUAAAUUCGAU | 83 | 4159-4179 | AUCGAAUUUAUUACAGGUGAGUU | 505 | 4157-4179 |
| AD-572059.1 | GACCUCAAGGUCACCAUAAAU | 479 | 4177-4197 | AUUUAUGGUGACCUUGAGGUCGA | 506 | 4175-4197 |
| AD-572061.1 | CCUCAAGGUCACCAUAAAACU | 88 | 4179-4199 | AGUUUUAUGGUGACCUUGAGGUC | 176 | 4177-4199 |
| AD-572062.1 | CUCAAGGUCACCAUAAAACCU | 480 | 4180-4200 | AGGUUUUAUGGUGACCUUGAGGU | 507 | 4178-4200 |
| AD-572063.1 | UCAAGGUCACCAUAAAACCAU | 89 | 4181-4201 | AUGGUUUUAUGGUGACCUUGAGG | 508 | 4179-4201 |
| AD-572110.1 | GAUGCCAAGAACACUAUGAUU | 481 | 4228-4248 | AAUCAUAGUGUUCUUGGCAUCCU | 509 | 4226-4248 |
| AD-572144.1 | AGGAUGCCACUAUGUCUAUAU | 482 | 4280-4300 | AUAUAGACAUAGUGGCAUCCUGG | 510 | 4278-4300 |
| AD-572388.1 | CAAGGUCUACGCCUAUUACAU | 95 | 4524-4544 | AUGUAAUAGGCGUAGACCUUGAC | 511 | 4522-4544 |
| AD-572389.1 | AAGGUCUACGCCUAUUACAAU | 96 | 4525-4545 | AUUGUAAUAGGCGUAGACCUUGA | 184 | 4523-4545 |
| AD-572390.1 | AGGUCUACGCCUAUUACAACU | 97 | 4526-4546 | AGUUGUAAUAGGCGUAGACCUUG | 185 | 4524-4546 |

TABLE 5

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-569034.1 | ascsggucAfuGfGfUfcaacauugau | 512 | asUfscaaUfgUfUfgaccAfuGfaccguscsc | 536 | GGACGGUCAUGGUCAACAUUGAG | 570 |
| AD-569164.1 | asgsauccGfaGfCfCfuacuaugaau | 513 | asUfsucaUfaGfUfaggcUfcGfgaucususc | 537 | GAAGAUCCGAGCCUACUAUGAAA | 571 |
| AD-569165.1 | gsasuccgAfgCfCfUfacuaugaaau | 514 | asUfsuucAfuAfGfuaggCfuCfggaucsusu | 538 | AAGAUCCGAGCCUACUAUGAAAA | 572 |
| AD-569272.1 | asasuucuAfcUfAfCfaucuauaacu | 206 | asGfsuuaUfaGfAfuguaGfuAfgaauususc | 539 | GAAAUUCUACUACAUCUAUAACG | 382 |
| AD-569763.1 | usgsggcaAfcUfCfCfaacaauuacu | 515 | asGfsuaaUfuGfUfuggaGfuUfgcccascsg | 540 | CGUGGGCAACUCCAACAAUUACC | 573 |
| AD-569765.1 | gsgscaacUfcCfAfAfcaauuaccuu | 516 | asAfsgguAfaUfUfguugGfaGfuugccscsa | 541 | UGGGCAACUCCAACAAUUACCUG | 574 |
| AD-570130.1 | csgsuguuCfgUfGfCfugaauaagau | 517 | asUfscuuAfuUfCfagcaCfgAfacacgscsc | 542 | GGCGUGUUCGUGCUGAAUAAGAA | 575 |
| AD-570132.1 | usgsuucgUfgCfUfGfaauaagaagu | 518 | asCfsuucUfuAfUfucagCfaCfgaacascsg | 543 | CGUGUUCGUGCUGAAUAAGAAGA | 576 |
| AD-570133.1 | gsusucguGfcUfGfAfauaagaagau | 519 | asUfscuuCfuUfAfuucaGfcAfcgaacsasc | 544 | GUGUUCGUGCUGAAUAAGAAGAA | 577 |
| AD-570134.1 | ususcgugCfuGfAfAfuaagaagaau | 520 | asUfsucuUfcUfUfauucAfgCfacgaascsa | 545 | UGUUCGUGCUGAAUAAGAAGAAC | 578 |
| AD-570157.1 | ascsugacGfcAfGfAfguaagaucuu | 219 | asAfsgauCfuUfAfcucuGfcGfucagususu | 546 | AAACUGACGCAGAGUAAGAUCUG | 395 |
| AD-570711.1 | uscscgagCfcGfUfUfcucuacaauu | 521 | asAfsuugUfaGfAfgaacGfgCfucggasusu | 547 | AAUCCGAGCCGUUCUCUACAAUU | 579 |
| AD-570712.1 | cscsgagcCfgUfUfCfucuacaauuu | 522 | asAfsauuGfuAfGfagaaCfgGfcucggasu | 548 | AUCCGAGCCGUUCUCUACAAUUA | 580 |
| AD-570713.1 | csgsagccGfuUfCfUfcuacaauuau | 523 | asUfsaauUfgUfAfgagaAfcGfgcucgsgsa | 549 | UCCGAGCCGUUCUCUACAAUUAC | 581 |
| AD-570714.1 | gsasgccgUfuCfUfCfuacaauuacu | 524 | asGfsuaaUfuGfUfagagAfaCfggcucsgsg | 550 | CCGAGCCGUUCUCUACAAUUACC | 582 |
| AD-571539.1 | ususccuuGaAfGfCfcaacuacauu | 246 | asAfsuguAfgUfUfggcuUfcAfaggaasgsu | 551 | ACUUCCUUGAAGCCAACUACAUG | 422 |
| AD-571610.1 | gscscucuUfcUfUfAfacaaauuucu | 525 | asGfsaaaUfuUfGfuuaaGfaAfgaggcscsc | 552 | GGGCCUCUUCUUAACAAAUUUCU | 583 |
| AD-571633.1 | cscsacagCfcAfAfAfgauaagaacu | 526 | asGfsuucUfuAfUfcuuuGfgCfuguggsusc | 553 | GACCACAGCCAAAGAUAAGAACC | 584 |

TABLE 5-continued

Modified Sense and Antisense Strand Sequences of Complement Component C3 dsRNA Agents

| Duplex Name | Sense Sequence 5′ to 3′ | SEQ ID NO: | Antisense Sequence 5′ to 3′ | SEQ ID NO: | mRNA target sequence | SEQ ID NO: |
|---|---|---|---|---|---|---|
| AD-571715.1 | csusacugCfaGfCfUfaaaagacuuu | 527 | asAfsaguCfuUfUfuagcUfgCfaguagsgsg | 554 | CCCUACUGCAGCUAAAAGACUUU | 585 |
| AD-571752.1 | uscsgugcGfuUfGfGfcucaaugaau | 528 | asUfsucaUfuGfAfgccaAfcGfcacgascsg | 555 | CGUCGUGCGUUGGCUCAAUGAAC | 586 |
| AD-571754.1 | gsusgcguUfgGfCfUfcaaugaacau | 529 | asUfsguuCfaUfUfgagcCfaAfcgcacsgsa | 556 | UCGUGCGUUGGCUCAAUGAACAG | 587 |
| AD-571828.1 | asgsccuuGfgCfUfCfaauaccaaau | 530 | asUfsuugGfuAfUfugagCfcAfaggcusgsg | 557 | CAAGCCUUGGCUCAAUACCAAAA | 588 |
| AD-572039.1 | asascucaCfcUfGfUfaauaaauucu | 531 | asGfsaauUfuAfUfuacaGfgUfgaguusgsa | 558 | UCAACUCACCUGUAAUAAAUUCG | 589 |
| AD-572040.1 | ascsucacCfuGfUfAfauaaauucgu | 258 | asCfsgaaUfuUfAfuuacAfgGfugagusgsg | 559 | CAACUCACCUGUAAUAAAUUCGA | 434 |
| AD-572041.1 | csuscaccUfgUfAfAfuaaauucgau | 259 | asUfscgaAfuUfUfauuaCfaGfgugagsusu | 560 | AACUCACCUGUAAUAAAUUCGAC | 435 |
| AD-572059.1 | gsasccucAfaGfGfUfcaccauaaau | 532 | asUfsuuaUfgGfUfgaccUfuGfaggucsgsa | 561 | UCGACCUCAAGGUCACCAUAAAA | 590 |
| AD-572061.1 | cscsucaaGfgUfCfAfccauaaaacu | 264 | asGfsuuuUfaUfGfgugaCfcUfugaggsusc | 562 | GACCUCAAGGUCACCAUAAAACC | 440 |
| AD-572062.1 | csuscaagGfuCfAfCfcauaaaaccu | 533 | asGfsguuUfuAfUfggugAfcCfuugagsgsu | 563 | ACCUCAAGGUCACCAUAAAACCA | 591 |
| AD-572063.1 | uscsaaggUfcAfCfCfauaaaaccau | 265 | asUfsgguUfuUfAfugguGfaCfcuugasgsg | 564 | CCUCAAGGUCACCAUAAAACCAG | 441 |
| AD-572110.1 | gsasugccAfaGfAfAfcacuaugauu | 534 | asAfsucaUfaGfUfguucUfuGfgcaucscsu | 565 | AGGAUGCCAAGAACACUAUGAUC | 592 |
| AD-572144.1 | asgsgaugCfcAfCfUfaugucuauau | 535 | asUfsauaGfaCfAfuaguGfgCfauccusgsg | 566 | CCAGGAUGCCACUAUGUCUAUAU | 593 |
| AD-572388.1 | csasagguCfuAfCfGfccuauuacau | 271 | asUfsguaAfuAfGfgcguAfgAfccuugsasc | 567 | GUCAAGGUCUACGCCUAUUACAA | 447 |
| AD-572389.1 | asasggucUfaCfGfCfcuauuacaau | 272 | asUfsuguAfaUfAfggcgUfaGfaccuusgsa | 568 | UCAAGGUCUACGCCUAUUACAAC | 448 |
| AD-572390.1 | asgsgucuAfcGfCfCfuauuacaacu | 273 | asGfsuugUfaAfUfaggcGfuAfgaccusgsg | 569 | CAAGGUCUACGCCUAUUACAACC | 449 |

TABLE 6

Unmodified Sense and Antisense Strand Sequences of Complement Component C3 dsRNA Agents

| Duplex Name | Sense Sequence 5' to 3' | SEQ ID NO: | Range in NM_000064.3 | Antisense Sequence 5' to 3' | SEQ ID NO: | Range in NM_000064.3 |
|---|---|---|---|---|---|---|
| AD-568976.1 | AGACAGACAAGACCAUCUACU | 24 | 491-511 | AGUAGAUGGUCUUGUCUGUCUGG | 640 | 489-511 |
| AD-568978.1 | ACAGACAAGACCAUCUACACU | 594 | 493-513 | AGUGUAGAUGGUCUUGUCUGUCU | 641 | 491-513 |
| AD-569127.1 | UGGGACAUUCCGGAACUCGUU | 595 | 670-690 | AACGAGUUCCGGAAUGUCCCAAG | 642 | 668-690 |
| AD-569133.1 | AUUCCGGAACUCGUCAACAUU | 26 | 676-696 | AAUGUUGACGAGUUCCGGAAUGU | 114 | 674-696 |
| AD-569164.1 | AGAUCCGAGCCUACUAUGAAU | 460 | 707-727 | AUUCAUAGUAGGCUCGGAUCUUC | 484 | 705-727 |
| AD-569195.1 | GCAGGUCUUCUCCACUGAGUU | 596 | 738-758 | AACUCAGUGGAGAAGACCUGCUG | 643 | 736-758 |
| AD-569237.1 | GCCCAGUUUCGAGGUCAUAGU | 29 | 780-800 | ACUAUGACCUCGAAACUGGGCAG | 117 | 778-800 |
| AD-569239.1 | CCAGUUUCGAGGUCAUAGUGU | 597 | 782-802 | ACACUAUGACCUCGAAACUGGGC | 644 | 780-802 |
| AD-569272.1 | AAUUCUACUACAUCUAUAACU | 30 | 815-835 | AGUUAUAGAUGUAGUAGAAUUUC | 118 | 813-835 |
| AD-569350.1 | ACUGCCUUUGUCAUCUUCGGU | 598 | 895-915 | ACCGAAGAUGACAAAGGCAGUUC | 645 | 893-915 |
| AD-569571.1 | CUCAUGGUGUUCGUGACGAAU | 599 | 1207-1227 | AUUCGUCACGAACACCAUGAGGU | 646 | 1205-1227 |
| AD-569763.1 | UGGGCAACUCCAACAAUUACU | 462 | 1439-1459 | AGUAAUUGUUGGAGUUGCCCACG | 486 | 1437-1459 |
| AD-569764.1 | GGGCAACUCCAACAAUUACCU | 36 | 1440-1460 | AGGUAAUUGUUGGAGUUGCCCAC | 647 | 1438-1460 |
| AD-569766.1 | GCAACUCCAACAAUUACCUGU | 37 | 1442-1462 | ACAGGUAAUUGUUGGAGUUGCCC | 125 | 1440-1462 |
| AD-569816.1 | GUCAACUUCCUCCUGCGAAUU | 600 | 1510-1530 | AAUUCGCAGGAGGAAGUUGACGU | 648 | 1508-1530 |
| AD-570156.1 | AACUGACGCAGAGUAAGAUCU | 601 | 1922-1942 | AGAUCUUACUCUGCGUCAGUUUG | 649 | 1920-1942 |
| AD-570466.1 | UGCAGAAGAGAACAUCGUUUU | 44 | 2361-2381 | AAAACGAUGUUCUCUUCUGCAAU | 132 | 2359-2381 |
| AD-570470.1 | GAAGAGAACAUCGUUUCCCGU | 602 | 2365-2385 | ACGGGAAACGAUGUUCUCUUCUG | 650 | 2363-2385 |
| AD-570471.1 | AAGAGAACAUCGUUUCCCGAU | 603 | 2366-2386 | AUCGGGAAACGAUGUUCUCUUCU | 651 | 2364-2386 |
| AD-570474.1 | AGAACAUCGUUUCCCGAAGUU | 604 | 2369-2389 | AACUUCGGGAAACGAUGUUCUCU | 652 | 2367-2389 |
| AD-570475.1 | GAACAUCGUUUCCCGAAGUGU | 605 | 2370-2390 | ACACUUCGGGAAACGAUGUUCUC | 653 | 2368-2390 |
| AD-570476.1 | AACAUCGUUUCCCGAAGUGAU | 606 | 2371-2391 | AUCACUUCGGGAAACGAUGUUCU | 654 | 2369-2391 |
| AD-570620.1 | CGGACAAGAAAGGGAUCUGUU | 48 | 2522-2542 | AACAGAUCCCUUUCUUGUCCGAC | 655 | 2520-2542 |
| AD-570621.1 | GGACAAGAAAGGGAUCUGUGU | 607 | 2523-2543 | ACACAGAUCCCUUUCUUGUCCGA | 656 | 2521-2543 |
| AD-570622.1 | GACAAGAAAGGGAUCUGUGUU | 608 | 2524-2544 | AACACAGAUCCCUUUCUUGUCCG | 657 | 2522-2544 |
| AD-570623.1 | ACAAGAAAGGGAUCUGUGUGU | 609 | 2525-2545 | ACACACAGAUCCCUUUCUUGUCC | 658 | 2523-2545 |
| AD-570624.1 | CAAGAAAGGGAUCUGUGUGGU | 610 | 2526-2546 | ACCACACAGAUCCCUUUCUUGUC | 659 | 2524-2546 |
| AD-570625.1 | AAGAAAGGGAUCUGUGUGGCU | 611 | 2527-2547 | AGCCACACAGAUCCCUUUCUUGU | 660 | 2525-2547 |
| AD-570627.1 | GAAAGGGAUCUGUGUGGCAGU | 612 | 2529-2549 | ACUGCCACACAGAUCCCUUUCUU | 661 | 2527-2549 |
| AD-570631.1 | CUUCGAGGUCACAGUAAUGCU | 613 | 2553-2573 | AGCAUUACUGUGACCUCGAAGGG | 662 | 2551-2573 |
| AD-570632.1 | UUCGAGGUCACAGUAAUGCAU | 614 | 2554-2574 | AUGCAUUACUGUGACCUCGAAGG | 663 | 2552-2574 |
| AD-570672.1 | GGCUACCCUACUCUGUUGUUU | 615 | 2594-2614 | AAACAACAGAGUAGGGUAGCCGC | 664 | 2592-2614 |
| AD-570674.1 | CUACCCUACUCUGUUGUUCGU | 52 | 2596-2616 | ACGAACAACAGAGUAGGGUAGCC | 140 | 2594-2616 |
| AD-570675.1 | UACCCUACUCUGUUGUUCGAU | 53 | 2597-2617 | AUCGAACAACAGAGUAGGGUAGC | 141 | 2595-2617 |
| AD-570676.1 | ACCCUACUCUGUUGUUCGAAU | 54 | 2598-2618 | AUUCGAACAACAGAGUAGGGUAG | 142 | 2596-2618 |
| AD-570677.1 | CCCUACUCUGUUGUUCGAAAU | 55 | 2599-2619 | AUUUCGAACAACAGAGUAGGGUA | 143 | 2597-2619 |
| AD-570678.1 | CCUACUCUGUUGUUCGAAACU | 56 | 2600-2620 | AGUUUCGAACAACAGAGUAGGGU | 144 | 2598-2620 |

TABLE 6-continued

Unmodified Sense and Antisense Strand Sequences of Complement Component C3 dsRNA Agents

| Duplex Name | Sense Sequence 5' to 3' | SEQ ID NO: | Range in NM_000064.3 | Antisense Sequence 5' to 3' | SEQ ID NO: | Range in NM_000064.3 |
|---|---|---|---|---|---|---|
| AD-570679.1 | CUACUCUGUUGUUCGAAACGU | 57 | 2601-2621 | ACGUUUCGAACAACAGAGUAGGG | 145 | 2599-2621 |
| AD-570680.1 | UACUCUGUUGUUCGAAACGAU | 58 | 2602-2622 | AUCGUUUCGAACAACAGAGUAGG | 665 | 2600-2622 |
| AD-570681.1 | ACUCUGUUGUUCGAAACGAGU | 59 | 2603-2623 | ACUCGUUUCGAACAACAGAGUAG | 666 | 2601-2623 |
| AD-570682.1 | CUCUGUUGUUCGAAACGAGCU | 616 | 2604-2624 | AGCUCGUUUCGAACAACAGAGUA | 667 | 2602-2624 |
| AD-570717.1 | CCGUUCUCUACAAUUACCGGU | 60 | 2639-2659 | ACCGGUAAUUGUAGAGAACGGCU | 148 | 2637-2659 |
| AD-570963.1 | AACAAAACUGUGGCUGUUCGU | 617 | 2908-2928 | ACGAACAGCCACAGUUUUGUUCA | 668 | 2906-2928 |
| AD-571157.1 | GGUCAUCGCUGUGCAUUACCU | 618 | 3156-3176 | AGGUAAUGCACAGCGAUGACCGU | 669 | 3154-3176 |
| AD-571158.1 | GUCAUCGCUGUGCAUUACCUU | 619 | 3157-3177 | AAGGUAAUGCACAGCGAUGACCG | 670 | 3155-3177 |
| AD-571168.1 | UGCAUUACCUGGAUGAAACGU | 620 | 3167-3187 | ACGUUUCAUCCAGGUAAUGCACA | 671 | 3165-3187 |
| AD-571298.1 | CGUGGUCAAGGUCUUCUCUCU | 65 | 3336-3356 | AGAGAGAAGACCUUGACCACGUA | 153 | 3334-3356 |
| AD-571447.1 | CGGCCUUUGUUCUCAUCUCGU | 68 | 3524-3544 | ACGAGAUGAGAACAAAGGCCGUG | 672 | 3522-3544 |
| AD-571448.1 | GGCCUUUGUUCUCAUCUCGCU | 621 | 3525-3545 | AGCGAGAUGAGAACAAAGGCCGU | 673 | 3523-3545 |
| AD-571449.1 | GCCUUUGUUCUCAUCUCGCUU | 622 | 3526-3546 | AAGCGAGAUGAGAACAAAGGCCG | 674 | 3524-3546 |
| AD-571539.1 | UUCCUUGAAGCCAACUACAUU | 70 | 3616-3636 | AAUGUAGUUGGCUUCAAGGAAGU | 158 | 3614-3636 |
| AD-571719.1 | UGCAGCUAAAAGACUUUGACU | 75 | 3815-3835 | AGUCAAAGUCUUUUAGCUGCAGU | 163 | 3813-3835 |
| AD-571752.1 | UCGUGCGUUGGCUCAAUGAAU | 475 | 3848-3868 | AUUCAUUGAGCCAACGCACGACG | 500 | 3846-3868 |
| AD-571753.1 | CGUGCGUUGGCUCAAUGAACU | 76 | 3849-3869 | AGUUCAUUGAGCCAACGCACGAC | 675 | 3847-3869 |
| AD-571765.1 | CAAUGAACAGAGAUACUACGU | 623 | 3861-3881 | ACGUAGUAUCUCUGUUCAUUGAG | 676 | 3859-3881 |
| AD-571766.1 | AAUGAACAGAGAUACUACGGU | 624 | 3862-3882 | ACCGUAGUAUCUCUGUUCAUUGA | 677 | 3860-3882 |
| AD-571767.1 | AUGAACAGAGAUACUACGGUU | 625 | 3863-3883 | AACCGUAGUAUCUCUGUUCAUUG | 678 | 3861-3883 |
| AD-571825.1 | CCAAGCCUUGGCUCAAUACCU | 626 | 3921-3941 | AGGUAUUGAGCCAAGGCUUGGAA | 679 | 3919-3941 |
| AD-571826.1 | CAAGCCUUGGCUCAAUACCAU | 627 | 3922-3942 | AUGGUAUUGAGCCAAGGCUUGGA | 680 | 3920-3942 |
| AD-571900.1 | CCACCGUAUCCACUGGGAAUU | 628 | 4017-4037 | AAUUCCCAGUGGAUACGGUGGGU | 681 | 4015-4037 |
| AD-571945.1 | ACCAAGGAAAAUGAGGGUUUU | 80 | 4063-4083 | AAAACCCUCAUUUUCCUUGGUCU | 168 | 4061-4083 |
| AD-571948.1 | AAGGAAAAUGAGGGUUUCACU | 8 | 4066-4086 | AGUGAAACCCUCAUUUUCCUUGG | 169 | 4064-4086 |
| AD-572039.1 | AACUCACCUGUAAUAAAUUCU | 478 | 4157-4177 | AGAAUUUAUUACAGGUGAGUUGA | 503 | 4155-4177 |
| AD-572040.1 | ACUCACCUGUAAUAAAUUCGU | 82 | 4158-4178 | ACGAAUUUAUUACAGGUGAGUUG | 504 | 4156-4178 |
| AD-572041.1 | CUCACCUGUAAUAAAUUCGAU | 3 | 4159-4179 | AUCGAAUUUAUUACAGGUGAGUU | 505 | 4157-4179 |
| AD-572044.1 | ACCUGUAAUAAAUUCGACCUU | 84 | 4162-4182 | AAGGUCGAAUUUAUUACAGGUGA | 172 | 4160-4182 |
| AD-572049.1 | UAAUAAAUUCGACCUCAAGGU | 629 | 4167-4187 | ACCUUGAGGUCGAAUUUAUUACA | 682 | 4165-4187 |
| AD-572060.1 | ACCUCAAGGUCACCAUAAAAU | 87 | 4178-4198 | AUUUUAUGGUGACCUUGAGGUCG | 683 | 4176-4198 |
| AD-572061.1 | CCUCAAGGUCACCAUAAAACU | 88 | 4179-4199 | AGUUUUAUGGUGACCUUGAGGUC | 176 | 4177-4199 |
| AD-572062.1 | CUCAAGGUCACCAUAAAACCU | 480 | 4180-4200 | AGGUUUUAUGGUGACCUUGAGGU | 507 | 4178-4200 |
| AD-572108.1 | AGGAUGCCAAGAACACUAUGU | 630 | 4226-4246 | ACAUAGUGUUCUUGGCAUCCUGA | 684 | 4224-4246 |
| AD-572235.1 | CAGAUACAUCUCCAAGUAUGU | 90 | 4371-4391 | ACAUACUUGGAGAUGUAUCUGUC | 685 | 4369-4391 |
| AD-572258.1 | UGGACAAAGCCUUCUCCGAUU | 91 | 4394-4414 | AAUCGGAGAAGGCUUUGUCCAGC | 179 | 4392-4414 |
| AD-572278.1 | AGGAACACCCUCAUCAUCUAU | 631 | 4414-4434 | AUAGAUGAUGAGGGUGUUCCUAU | 686 | 4412-4434 |

TABLE 6-continued

Unmodified Sense and Antisense Strand Sequences of Complement Component C3 dsRNA Agents

| Duplex Name | Sense Sequence 5' to 3' | SEQ ID NO: | Range in NM_000064.3 | Antisense Sequence 5' to 3' | SEQ ID NO: | Range in NM_000064.3 |
|---|---|---|---|---|---|---|
| AD-572279.1 | GGAACACCCUCAUCAUCUACU | 632 | 4415-4435 | AGUAGAUGAUGAGGGUGUUCCUA | 687 | 4413-4435 |
| AD-572281.1 | AACACCCUCAUCAUCUACCUU | 633 | 4417-4437 | AAGGUAGAUGAUGAGGGUGUUCC | 688 | 4415-4437 |
| AD-572355.1 | CUUUAAUGUAGAGCUUAUCCU | 634 | 4491-4511 | AGGAUAAGCUCUACAUUAAAGUA | 689 | 4489-4511 |
| AD-572356.1 | UUUAAUGUAGAGCUUAUCCAU | 635 | 4492-4512 | AUGGAUAAGCUCUACAUUAAAGU | 690 | 4490-4512 |
| AD-572387.1 | UCAAGGUCUACGCCUAUUACU | 636 | 4523-4543 | AGUAAUAGGCGUAGACCUUGACU | 691 | 4521-4543 |
| AD-572388.1 | CAAGGUCUACGCCUAUUACAU | 95 | 4524-4544 | AUGUAAUAGGCGUAGACCUUGAC | 511 | 4522-4544 |
| AD-572389.1 | AAGGUCUACGCCUAUUACAAU | 96 | 4525-4545 | AUUGUAAUAGGCGUAGACCUUGA | 184 | 4523-4545 |
| AD-572390.1 | AGGUCUACGCCUAUUACAACU | 97 | 4526-4546 | AGUUGUAAUAGGCGUAGACCUUG | 185 | 4524-4546 |
| AD-572393.1 | UCUACGCCUAUUACAACCUGU | 99 | 4529-4549 | ACAGGUUGUAAUAGGCGUAGACC | 692 | 4527-4549 |
| AD-572613.1 | AGCUGUCCAAUGACUUUGACU | 104 | 4751-4771 | AGUCAAAGUCAUUGGACAGCUGA | 192 | 4749-4771 |
| AD-572614.1 | GCUGUCCAAUGACUUUGACGU | 105 | 4752-4772 | ACGUCAAAGUCAUUGGACAGCUG | 193 | 4750-4772 |
| AD-572858.1 | AGCAUGGUUGUCUUUGGGUGU | 637 | 5056-5076 | ACACCCAAAGACAACCAUGCUCU | 693 | 5054-5076 |
| AD-890084.1 | AAUAAGAAGAACAAACUGACA | 638 | 1909-1928 | UGUCAGUUUGUUCUUCUUAUUCA | 694 | 1907-1928 |
| AD-890085.1 | AAUAAGAAGAACAAGCUGACA | 639 | 1909-1928 | UGUCAGCUUGUUCUUCUUAUUCA | 695 | 1907-1928 |
| AD-572281 | AACACCCUCAUCAUCUACCUU | 633 | 4417-4436 | AAGGUAGAUGAUGAGGGUGUUCC | 688 | 4415-4436 |

TABLE 7

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-568976.1 | asgsacagAfcAfAfGfaccaucuacu | 200 | asGfsuagAfuGfGfucuuGfuCfugucusgsg | 742 | CCAGACAGACAAGACCAUCUACA | 376 |
| AD-568978.1 | ascsagacAfaGfAfCfcaucuacacu | 696 | asGfsuguAfgAfUfggucUfuGfucuguscsu | 743 | AGACAGACAAGACCAUCUACACC | 817 |
| AD-569127.1 | usgsggacAfuUfCfCfggaacucguu | 697 | asAfscgaGfuUfCfcggaAfuGfucccasasg | 744 | CUUGGGACAUUCCGGAACUCGUC | 818 |
| AD-569133.1 | asusuccgGfaAfCfUfcgucaacauu | 202 | asAfsuguUfgAfCfgaguUfcCfggaausgsu | 745 | ACAUUCCGGAACUCGUCAACAUG | 378 |
| AD-569164.1 | asgsauccGfaGfCfCfuacuaugaau | 513 | asUfsucaUfaGfUfaggcUfcGfgaucususc | 537 | GAAGAUCCGAGCCUACUAUGAAA | 571 |
| AD-569195.1 | gscsagguCfuUfCfUfccacugaguu | 698 | asAfscucAfgUfGfgagaAfgAfccugcsusg | 746 | CAGCAGGUCUUCUCCACUGAGUU | 819 |
| AD-569237.1 | gscsccagUfuUfCfGfaggucauagu | 205 | asCfsuauGfaCfCfucgaAfaCfugggcsasg | 747 | CUGCCCAGUUUCGAGGUCAUAGU | 381 |
| AD-569239.1 | cscsaguuUfcGfAfGfgucauagugu | 699 | asCfsacuAfuGfAfccucGfaAfacuggsgsc | 748 | GCCCAGUUUCGAGGUCAUAGUGG | 820 |

TABLE 7-continued

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-569272.1 | asasuucuAfcUfAfCfaucuauaacu | 206 | asGfsuuaUfaGfAfuguaGfuAfgaauususc | 539 | GAAAUUCUACUACAUCUAUAACG | 382 |
| AD-569350.1 | ascsugccUfuUfGfUfcaucuucggu | 700 | asCfscgaAfgAfUfgacaAfaGfgcagususc | 749 | GAACUGCCUUUGUCAUCUUCGGG | 821 |
| AD-569571.1 | csuscaugGfuGfUfUfcgugacgaau | 701 | asUfsucgUfcAfCfgaacAfcCfaugagsgsu | 750 | ACCUCAUGGUGUUCGUGACGAAC | 822 |
| AD-569763.1 | usgsggcaAfcUfCfCfaacaauuacu | 515 | asGfsuaaUfuGfUfuggaGfuUfgcccascsg | 540 | CGUGGGCAACUCCAACAAUUACC | 573 |
| AD-569764.1 | gsgsgcaaCfuCfCfAfacaauuaccu | 212 | asGfsguaAfuUfGfuuggAfgUfugcccsasc | 751 | GUGGGCAACUCCAACAAUUACCU | 388 |
| AD-569766.1 | gscsaacuCfcAfAfCfaauuaccugu | 213 | asCfsaggUfaAfUfuguuGfgAfguugcscsc | 752 | GGGCAACUCCAACAAUUACCUGC | 389 |
| AD-569816.1 | gsuscaacUfuCfCfUfccugegaauu | 702 | asAfsuucGfcAfGfgaggAfaGfuugacsgsu | 753 | ACGUCAACUUCCUCCUGCGAAUG | 823 |
| AD-570156.1 | asascugaCfgCfAfGfaguaagaucu | 703 | asGfsaucUfuAfCfucugCfgUfcaguususg | 754 | CAAACUGACGCAGAGUAAGAUCU | 824 |
| AD-570466.1 | usgscagaAfgAfGfAfacaucguuuu | 220 | asAfsaacGfaUfGfuucuCfuUfcugcasasu | 755 | AUUGCAGAAGAGAACAUCGUUUC | 396 |
| AD-570470.1 | gsasagagAfaCfAfUfcguuucccgu | 704 | asCfsgggAfaAfCfgaugUfuCfucuucsusg | 756 | CAGAAGAGAACAUCGUUUCCCGA | 825 |
| AD-570471.1 | asasgagaAfcAfUfCfguuucccgau | 705 | asUfscggGfaAfAfcgauGfuUfcucuuscsu | 757 | AGAAGAGAACAUCGUUUCCCGAA | 826 |
| AD-570474.1 | asgsaacaUfcGfUfUfucccgaaguu | 706 | asAfscuuCfgGfGfaaacGfaUfguucuscsu | 758 | AGAGAACAUCGUUUCCCGAAGUG | 827 |
| AD-570475.1 | gsasacauCfgUfUfUfcccgaagugu | 707 | asCfsacuUfcGfGfgaaaCfgAfuguucsusc | 759 | GAGAACAUCGUUUCCCGAAGUGA | 828 |
| AD-570476.1 | asascaucGfuUfUfCfccgaagugau | 708 | asUfscacUfuCfGfggaaAfcGfauguuscsu | 760 | AGAACAUCGUUUCCCGAAGUGAG | 829 |
| AD-570620.1 | csgsgacaAfgAfAfAfgggaucuguu | 224 | asAfscagAfuCfCfcuuuCfuUfguccgsasc | 761 | GUCGGACAAGAAAGGGAUCUGUG | 400 |
| AD-570621.1 | gsgsacaaGfaAfAfGfggaucugugu | 709 | asCfsacaGfaUfCfccuuUfcUfuguccsgsa | 762 | UCGGACAAGAAAGGGAUCUGUGU | 830 |
| AD-570622.1 | gsascaagAfaAfGfGfgaucuguguu | 710 | asAfscacAfgAfUfcccuUfuCfuugucscsg | 763 | CGGACAAGAAAGGGAUCUGUGUG | 831 |
| AD-570623.1 | ascsaagaAfaGfGfGfaucugugugu | 711 | asCfsacaCfaGfAfucccUfuUfcuuguscsc | 764 | GGACAAGAAAGGGAUCUGUGUGG | 832 |

TABLE 7-continued

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-570624.1 | csasagaaAfgGfGfAfucugugu ggu | 712 | asCfscacAfcAfGfauccCfuUf ucuugsusc | 765 | GACAAGAAAGGG AUCUGUGUGGC | 833 |
| AD-570625.1 | asasgaaaGfgGfAfUfcugugug gcu | 713 | asGfsccaCfaCfAfgaucCfcUf uucuusgsu | 766 | ACAAGAAAGGGA UCUGUGUGGCA | 834 |
| AD-570627.1 | gsasaaggGfaUfCfUfguguggc agu | 714 | asCfsugcCfaCfAfcagaUfcCf cuuucsusu | 767 | AAGAAAGGGAUC UGUGUGGCAGA | 835 |
| AD-570631.1 | csusucgaGfgUfCfAfcaguaau gcu | 715 | asGfscauUfaCfUfgugaCfcUf cgaagsgsg | 768 | CCCUUCGAGGUC ACAGUAAUGCA | 836 |
| AD-570632.1 | ususcgagGfuCfAfCfaguaaug cau | 716 | asUfsgcaUfuAfCfugugAfcCf ucgaasgsg | 769 | CCUUCGAGGUCA CAGUAAUGCAG | 837 |
| AD-570672.1 | gsgscuacCfcUfAfCfucuguug uuu | 717 | asAfsacaAfcAfGfaguaGfgGf uagccsgsc | 770 | GCGGCUACCCUA CUCUGUUGUUC | 838 |
| AD-570674.1 | csusacccUfaCfUfCfuguuguu cgu | 228 | asCfsgaaCfaAfCfagagUfaGf gguagscsc | 771 | GGCUACCCUACU CUGUUGUUCGA | 404 |
| AD-570675.1 | usascccuAfcUfCfUfguuguuc gau | 229 | asUfscgaAfcAfAfcagaGfuAf ggguasgsc | 772 | GCUACCCUACUC UGUUGUUCGAA | 405 |
| AD-570676.1 | ascsccuaCfuCfUfGfuuguucg aau | 230 | asUfsucgAfaCfAfacagAfgUf agggusasg | 773 | CUACCCUACUCU GUUGUUCGAAA | 406 |
| AD-570677.1 | cscscuacUfcUfGfUfuguucga aau | 231 | asUfsuucGfaAfCfaacaGfaGf uagggsusa | 774 | UACCCUACUCUG UUGUUCGAAAC | 407 |
| AD-570678.1 | cscsuacuCfuGfUfUfguucgaa acu | 232 | asGfsuuuCfgAfAfcaacAfgAf guaggsgsu | 775 | ACCCUACUCUGU UGUUCGAAACG | 408 |
| AD-570679.1 | csusacucUfgUfUfGfuucgaaa cgu | 233 | asCfsguuUfcGfAfacaaCfaGf aguagsgsg | 776 | CCCUACUCUGUU GUUCGAAACGA | 409 |
| AD-570680.1 | usascucuGfuUfGfUfucgaaac gau | 234 | asUfscguUfuCfGfaacaAfcAf gaguasgsg | 777 | CCUACUCUGUUG UUCGAAACGAG | 410 |
| AD-570681.1 | ascsucugUfuGfUfUfcgaaacg agu | 235 | asCfsucgUfuUfCfgaacAfaCf agagusasg | 778 | CUACUCUGUUGU UCGAAACGAGC | 411 |
| AD-570682.1 | csuscuguUfgUfUfCfgaaacga gcu | 718 | asGfscucGfuUfUfcgaaCfaAf cagagsusa | 779 | UACUCUGUUGUU CGAAACGAGCA | 839 |
| AD-570717.1 | cscsguucUfcUfAfCfaauuacc ggu | 236 | asCfscggUfaAfUfuguaGfaGf aacggscsu | 780 | AGCCGUUCUCUA CAAUUACCGGC | 412 |
| AD-570963.1 | asascaaaAfcUfGfUfggcuguu cgu | 719 | asCfsgaaCfaGfCfcacaGfuUf uuguuscsa | 781 | UGAACAAAACUG UGGCUGUUCGC | 840 |
| AD-571157.1 | gsgsucauCfgCfUfGfugcauua ccu | 720 | asGfsguaAfuGfCfacagCfgAf ugaccsgsu | 782 | ACGGUCAUCGCU GUGCAUUACCU | 841 |

TABLE 7-continued

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-571158.1 | gsuscaucGfcUfGfUfgcauuaccuu | 721 | asAfsgguAfaUfGfcacaGfcGfaugacscsg | 783 | CGGUCAUCGCUGUGCAUUACCUG | 842 |
| AD-571168.1 | usgscauuAfcCfUfGfgaugaaacgu | 722 | asCfsguuUfcAfUfccagGfuAfaugcascsa | 784 | UGUGCAUUACCUGGAUGAAACGG | 843 |
| AD-571298.1 | csgsugguCfaAfGfGfucuucucucu | 241 | asGfsagaGfaAfGfaccuUfgAfccacgsusa | 785 | UACGUGGUCAAGGUCUUCUCUCU | 417 |
| AD-571447.1 | csgsgccuUfuGfUfUfcucaucucgu | 244 | asCfsgagAfuGfAfgaacAfaAfggccgsusg | 786 | CACGGCCUUUGUUCUCAUCUCGC | 420 |
| AD-571448.1 | gsgsccuuUfgUfUfCfucaucucgcu | 723 | asGfscgaGfaUfGfagaaCfaAfaggccsgsu | 787 | ACGGCCUUUGUUCUCAUCUCGCU | 844 |
| AD-571449.1 | gscscuuuGfuUfCfUfcaucucgcuu | 724 | asAfsgcgAfgAfUfgagaAfcAfaaggcscsg | 788 | CGGCCUUUGUUCUCAUCUCGCUG | 845 |
| AD-571539.1 | ususccuuGaAfGfCfcaacuacauu | 246 | asAfsuguAfgUfUfggcuUfcAfaggaasgsu | 551 | ACUUCCUUGAAGCCAACUACAUG | 422 |
| AD-571719.1 | usgscagcUfaAfAfAfgacuuugacu | 251 | asGfsucaAfaGfUfcuuuUfaGfcugcasgsu | 789 | ACUGCAGCUAAAAGACUUUGACU | 427 |
| AD-571752.1 | uscsgugcGfuUfGfGfcucaaugaau | 528 | asUfsucaUfuGfAfgccaAfcGfcacgascsg | 555 | CGUCGUGCGUUGGCUCAAUGAAC | 586 |
| AD-571753.1 | csgsugcgUfuGfGfCfucaaugaacu | 252 | asGfsuucAfuUfGfagccAfaCfgcacgsasc | 790 | GUCGUGCGUUGGCUCAAUGAACA | 428 |
| AD-571765.1 | csasaugaAfcAfGfAfgauacuacgu | 725 | asCfsguaGfuAfUfcucuGfuUfcauugsasg | 791 | CUCAAUGAACAGAGAUACUACGG | 846 |
| AD-571766.1 | asasugaaCfaGfAfGfauacuacggu | 726 | asCfscguAfgUfAfucucUfgUfucauusgsa | 792 | UCAAUGAACAGAGAUACUACGGU | 847 |
| AD-571767.1 | asusgaacAfgAfGfAfuacuacgguu | 727 | asAfsccgUfaGfUfaucuCfuGfuucaususg | 793 | CAAUGAACAGAGAUACUACGGUG | 848 |
| AD-571825.1 | cscsaagcCfuUfGfGfcucaauaccu | 728 | asGfsguaUfuGfAfgccaAfgGfcuuggsasa | 794 | UUCCAAGCCUUGGCUCAAUACCA | 849 |
| AD-571826.1 | csasagccUfuGfGfCfucaauaccau | 729 | asUfsgguAfuUfGfagccAfaGfgcuugsgsa | 795 | UCCAAGCCUUGGCUCAAUACCAA | 850 |
| AD-571900.1 | cscsaccgUfaUfCfCfacugggaauu | 730 | asAfsuucCfcAfGfuggaUfaCfgguggsgsu | 796 | ACCCACCGUAUCCACUGGGAAUC | 851 |
| AD-571945.1 | ascscaagGfaAfAfAfugagggguuu | 256 | asAfsaacCfcUfCfauuuUfcCfuuggusgsu | 797 | AGACCAAGGAAAAUGAGGGUUUC | 432 |
| AD-571948.1 | asasggaaAfaUfGfAfggguuucacu | 257 | asGfsugaAfaCfCfcucaUfuUfuccuusgsg | 798 | CCAAGGAAAAUGAGGGUUUCACA | 433 |

TABLE 7-continued

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-572039.1 | asascucaCfcUfGfUfaauaaauucu | 531 | asGfsaauUfuAfUfuacaGfgUfgaguusgsa | 558 | UCAACUCACCUGUAAUAAAUUCG | 589 |
| AD-572040.1 | ascsucacCfuGfUfAfauaaauucgu | 258 | asCfsgaaUfuUfAfuuacAfgGfugagususg | 559 | CAACUCACCUGUAAUAAAUUCGA | 434 |
| AD-572041.1 | csuscaccUfgUfAfAfuaaauucgau | 259 | asUfscgaAfuUfUfauuaCfaGfgugagsusu | 560 | AACUCACCUGUAAUAAAUUCGAC | 435 |
| AD-572044.1 | ascscuguAfaUfAfAfauucgaccuu | 260 | asAfsgguCfgAfAfuuuaUfuAfcaggusgsa | 799 | UCACCUGUAAUAAAUUCGACCUC | 436 |
| AD-572049.1 | usasauaaAfuUfCfGfaccucaaggu | 731 | asCfscuuGfaGfGfucgaAfuUfuauuascsa | 800 | UGUAAUAAAUUCGACCUCAAGGU | 852 |
| AD-572060.1 | ascscucaAfgGfUfCfaccauaaaau | 263 | asUfsuuuAfuGfGfugacCfuUfgagguscsg | 801 | CGACCUCAAGGUCACCAUAAAAC | 439 |
| AD-572061.1 | cscsucaaGfgUfCfAfccauaaaacu | 264 | asGfsuuuUfaUfGfgugaCfcUfugaggsusc | 562 | GACCUCAAGGUCACCAUAAAACC | 440 |
| AD-572062.1 | csuscaagGfuCfAfCfcauaaaaccu | 533 | asGfsguuUfuAfUfggugAfcCfuugagsgsu | 563 | ACCUCAAGGUCACCAUAAAACCA | 591 |
| AD-572108.1 | asgsgaugCfcAfAfGfaacacuaugu | 732 | asCfsauaGfuGfUfucuuGfgCfauccusgsa | 802 | UCAGGAUGCCAAGAACACUAUGA | 853 |
| AD-572235.1 | csasgauaCfaUfCfUfccaaguaugu | 266 | asCfsauaCfuUfGfgagaUfgUfaucugsusc | 803 | GACAGAUACAUCUCCAAGUAUGA | 442 |
| AD-572258.1 | usgsgacaAfaGfCfUfucuccgauu | 267 | asAfsucgGfaGfAfaggcUfuUfguccasgsc | 804 | GCUGGACAAAGCUUCUCCGAUA | 443 |
| AD-572278.1 | asgsgaacAfcCfCfUfcaucaucuau | 733 | asUfsagaUfgAfUfgaggGfuGfuuccusasu | 805 | AUAGGAACACCCUCAUCAUCUAC | 854 |
| AD-572279.1 | gsgsaacaCfcCfUfCfaucaucuacu | 734 | asGfsuagAfuGfAfugagGfgUfguuccsusa | 806 | UAGGAACACCCUCAUCAUCUACC | 855 |
| AD-572281.1 | asascaccCfuCfAfUfcaucuaccuu | 735 | asAfsgguAfgAfUfgaugAfgGfguguuscsc | 807 | GGAACACCCUCAUCAUCUACCUG | 856 |
| AD-572355.1 | csusuuaaUfgUfAfGfagcuuauccu | 736 | asGfsgauAfaGfCfucuaCfaUfuaaagsusa | 808 | UACUUUAAUGUAGAGCUUAUCCA | 857 |
| AD-572356.1 | ususuaauGfuAfGfAfgcuuaucau | 737 | asUfsggaUfaAfGfcucuAfcAfuuaaasgsu | 809 | ACUUUAAUGUAGAGCUUAUCCAG | 858 |
| AD-572387.1 | uscsaaggUfcUfAfCfgccuauuacu | 738 | asGfsuaaUfaGfGfcguaGfaCfcuugascsu | 810 | AGUCAAGGUCUACGCCUAUUACA | 859 |
| AD-572388.1 | csasagguCfuAfCfGfccuauuacau | 271 | asUfsguaAfuAfGfgcguAfgAfccuugsasc | 567 | GUCAAGGUCUACGCCUAUUACAA | 447 |

TABLE 7-continued

Modified Sense and Antisense Strand Sequences of Complement Component C3 dsRNA Agents

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-572389.1 | asasggucUfaCfGfCfcuauuacaau | 272 | asUfsuguAfaUfAfggcgUfaGfaccuusgsa | 568 | UCAAGGUCUACGCCUAUUACAAC | 448 |
| AD-572390.1 | asgsgucuAfcGfCfCfuauuacaacu | 273 | asGfsuugUfaAfUfaggcGfuAfgaccusugsg | 569 | CAAGGUCUACGCCUAUUACAACC | 449 |
| AD-572393.1 | uscsuacgCfcUfAfUfuacaaccugu | 275 | asCfsaggUfuGfUfaauaGfgCfguagascsc | 811 | GGUCUACGCCUAUUACAACCUGG | 451 |
| AD-572613.1 | asgscuguCfcAfAfUfgacuuugacu | 280 | asGfsucaAfaGfUfcauuGfgAfcagcusgsa | 812 | UCAGCUGUCCAAUGACUUUGACG | 456 |
| AD-572614.1 | gscsugucCfaAfUfGfacuuugacgu | 281 | asCfsgucAfaAfGfucauUfgGfacagcsusg | 813 | CAGCUGUCCAAUGACUUUGACGA | 457 |
| AD-572858.1 | asgscaugGfuUfGfUfcuuugggugu | 739 | asCfsaccCfaAfAfgacaAfcCfaugcuscsu | 814 | AGAGCAUGGUUGUCUUUGGGUGC | 860 |
| AD-890084.1 | asasuaagAfaGfAfAfcaaacugaca | 740 | usGfsucaGfuuuguucUfuCfuuauuscsa | 815 | AAUAAGAAGAACAAACUGACA | 861 |
| AD-890085.1 | asasuaagAfaGfAfAfcaagcugaca | 741 | usGfsucaGfcuuguucUfuCfuuauuscsa | 816 | AAUAAGAAGAACAAGCUGACA | 862 |
| AD-572281.1 | asascaccCfuCfAfUfcaucuaccuu | 735 | asAfsgguAfgAfUfgaugAfgGfguguuscsc | 807 | AACACCCUCAUCAUCUACCUU | 863 |

| Duplex | Sense Sequence 5' to 3' | SEQ ID NO | Antisense Sequence 5' to 3' | SEQ ID NO | Antisense source (on NM_000064.4) |
|---|---|---|---|---|---|
| 580084 | GUGGUCAAGGUCUUCUCUCUA | 864 | UAGAGAGAAGACCUUGACCACGU | 1020 | 3303-3324_1U_as |
| 580087 | UACCUCUUCAUCCAGACAGAA | 865 | UUCUGUCUGGAUGAAGAGGUACC | 1021 | 444-465_1U_as |
| 580089 | CCAGAUCCACUUCACCAAGAA | 866 | UUCUUGGUGAAGUGGAUCUGGUA | 1022 | 1118-1139_1U_as |
| 1184757 | CGGGUACCUCUUCAUCCAGAA | 867 | UUCUGGAUGAAGAGGUACCCGCU | 1023 | 440-462_G1U_as |
| 1184761 | GUACCUCUUCAUCCAGACAGA | 868 | UCUGUCUGGAUGAAGAGGUACCC | 1024 | 443-465_as |
| 1184769 | CAUCCAGACAGACAAGACCAA | 869 | UUGGUCUUGUCUGUCUGGAUGAA | 1025 | 452-474_A1U_as |
| 1184772 | CCAGACAGACAAGACCAUCUA | 870 | UAGAUGGUCUUGUCUGUCUGGAU | 1026 | 455-477_as |
| 1184774 | AGACAGACAAGACCAUCUACA | 871 | UGUAGAUGGUCUUGUCUGUCUGG | 1027 | 457-479_as |
| 1184775 | ACAGACAAGACCAUCUACACA | 872 | UGUGUAGAUGGUCUUGUCUGUCU | 1028 | 459-481_G1U_as |
| 1184760 | GACAGACAAGACCAUCUACAA | 873 | UUGUAGAUGGUCUUGUCUGUCUG | 1029 | 479-458_1U_as |
| 1184831 | ACGGUCAUGGUCAACAUUGAA | 874 | UUCAAUGUUGACCAUGACCGUCC | 1030 | 543-565_C1U_as |
| 1184924 | UGGGACAUUCCGGAACUCGUA | 875 | UACGAGUUCCGGAAUGUCCCAAG | 1031 | 636-658_G1U_as |
| 1184930 | AUUCCGGAACUCGUCAACAUA | 876 | UAUGUUGACGAGUUCCGGAAUGU | 1032 | 642-664_C1U_as |
| 1184961 | AGAUCCGAGCCUACUAUGAAA | 877 | UUUCAUAGUAGGCUCGGAUCUUC | 1033 | 676-697_as |
| 1184962 | GAUCCGAGCCUACUAUGAAAA | 878 | UUUUCAUAGUAGGCUCGGAUCUU | 1034 | 674-696_as |

-continued

| Duplex | Sense Sequence 5' to 3' | SEQ ID NO | Antisense Sequence 5' to 3' | SEQ ID NO | Antisense source (on NM_000064.4) |
|---|---|---|---|---|---|
| 1184992 | GCAGGUCUUCUCCACUGAGUA | 879 | UACUCAGUGGAGAAGACCUGCUG | 1035 | 704-726_A1U_as |
| 1185004 | CACUGAGUUUGAGGUGAAGGA | 880 | UCCUUCACCUCAAACUCAGUGGA | 1036 | 716-738_as |
| 1185005 | ACUGAGUUUGAGGUGAAGGAA | 881 | UUCCUUCACCUCAAACUCAGUGG | 1037 | 717-739_C1U_as |
| 1185036 | GCCCAGUUUCGAGGUCAUAGA | 882 | UCUAUGACCUCGAAACUGGGCAG | 1038 | 746-768_A1U_as |
| 1185038 | CCAGUUUCGAGGUCAUAGUGA | 883 | UCACUAUGACCUCGAAACUGGGC | 1039 | 748-770_C1U_as |
| 1185064 | AAUUCUACUACAUCUAUAACA | 884 | UGUUAUAGAUGUAGUAGAAUUUC | 1040 | 784-805_G21A_as |
| 1185147 | ACUGCCUUUGUCAUCUUCGGA | 885 | UCCGAAGAUGACAAAGGCAGUUC | 1041 | 861-883_C1U_as |
| 1185307 | UCCCUACCAGAUCCACUUCAA | 886 | UUGAAGUGGAUCUGGUAGGGAGA | 1042 | 1112-1134_G1U_as |
| 1185308 | CCCUACCAGAUCCACUUCACA | 887 | UGUGAAGUGGAUCUGGUAGGGAG | 1043 | 1113-1135_G1U_as |
| 1185310 | CUACCAGAUCCACUUCACCAA | 888 | UUGGUGAAGUGGAUCUGGUAGGG | 1044 | 1115-1137_as |
| 1185311 | UACCAGAUCCACUUCACCAAA | 889 | UUUGGUGAAGUGGAUCUGGUAGG | 1045 | 1116-1138_C1U_as |
| 1185367 | CUCAUGGUGUUCGUGACGAAA | 890 | UUUCGUCACGAACACCAUGAGGU | 1046 | 1173-1195_G1U_as |
| 1185559 | UGGGCAACUCCAACAAUUACA | 891 | UGUAAUUGUUGGAGUUGCCCACG | 1047 | 1405-1427_G1U_as |
| 1185560 | GGGCAACUCCAACAAUUACCA | 892 | UGGUAAUUGUUGGAGUUGCCCAC | 1048 | 1406-1428_A1U_as |
| 1185561 | GGCAACUCCAACAAUUACCUA | 893 | UAGGUAAUUGUUGGAGUUGCCCA | 1049 | 1407-1429_C1U_as |
| 1185562 | GCAACUCCAACAAUUACCUGA | 894 | UCAGGUAAUUGUUGGAGUUGCCC | 1050 | 1408-1430_G1U_as |
| 1185563 | CAACUCCAACAAUUACCUGCA | 895 | UGCAGGUAAUUGUUGGAGUUGCC | 1051 | 1409-1431_as |
| 1185567 | CAACAAUUACCUGCAUCUCUA | 896 | UAGAGAUGCAGGUAAUUGUUGGA | 1052 | 1418-1439_C21A_as |
| 1185612 | GUCAACUUCCUCCUGCGAAUA | 897 | UAUUCGCAGGAGGAAGUUGACGU | 1053 | 1476-1498_C1U_as |
| 1185644 | CAAGAUCCGCUACUACACCUA | 898 | UAGGUGUAGUAGCGGAUCUUGGC | 1054 | 1514-1536_as |
| 1186177 | CGUGUUCGUGCUGAAUAAGAA | 899 | UUCUUAUUCAGCACGAACACGCC | 1055 | 1862-1884_as |
| 1186179 | UGUUCGUGCUGAAUAAGAAGA | 900 | UCUUCUUAUUCAGCACGAACACG | 1056 | 1864-1886_as |
| 1186180 | GUUCGUGCUGAAUAAGAAGAA | 901 | UUCUUCUUAUUCAGCACGAACAC | 1057 | 1865-1887_as |
| 1186181 | UUCGUGCUGAAUAAGAAGAAA | 902 | UUUCUUCUUAUUCAGCACGAACA | 1058 | 1866-1888_G1U_as |
| 1186183 | CGUGCUGAAUAAGAAGAACAA | 903 | UUGUUCUUCUUAUUCAGCACGAA | 1059 | 1868-1890_as |
| 1186184 | GUGCUGAAUAAGAAGAACAAA | 904 | UUUGUUCUUCUUAUUCAGCACGA | 1060 | 1869-1891_as |
| 1186190 | AAUAAGAAGAACAAACUGACA | 638 | UGUCAGUUUGUUCUUCUUAUUCA | 694 | 1875-1897_C1U_as |
| 1186202 | AACUGACGCAGAGUAAGAUCA | 905 | UGAUCUUACUCUGCGUCAGUUUG | 1061 | 1888-1910_A1U_as |
| 1186203 | ACUGACGCAGAGUAAGAUCUA | 906 | UAGAUCUUACUCUGCGUCAGUUU | 1062 | 1889-1911_C1U_as |
| 1186771 | UGCAGAAGAGAACAUCGUUUA | 907 | UAAACGAUGUUCUCUUCUGCAAU | 1063 | 2330-2351_C21A_as |
| 1186866 | GAAGAGAACAUCGUUUCCCGA | 908 | UCGGGAAACGAUGUUCUCUUCUG | 1064 | 2331-2353_as |
| 1186867 | AAGAGAACAUCGUUUCCCGAA | 909 | UUCGGGAAACGAUGUUCUCUUCU | 1065 | 2332-2354_as |
| 1186870 | AGAACAUCGUUUCCCGAAGUA | 910 | UACUUCGGGAAACGAUGUUCUCU | 1066 | 2335-2357_C1U_as |
| 1186871 | GAACAUCGUUUCCCGAAGUGA | 911 | UCACUUCGGGAAACGAUGUUCUC | 1067 | 2336-2358_as |
| 1186922 | AACAUCGUUUCCCGAAGUGAA | 912 | UUCACUUCGGGAAACGAUGUUCU | 1068 | 2337-2359_C1U_as |
| 1187161 | CAUGUCGGACAAGAAAGGGAA | 913 | UUCCCUUUCUUGUCCGACAUGCU | 1069 | 2483-2505_A1U_as |
| 1187162 | AUGUCGGACAAGAAAGGGAUA | 914 | UAUCCCUUUCUUGUCCGACAUGC | 1070 | 2484-2506_G1U_as |

-continued

| Duplex | Sense Sequence 5' to 3' | SEQ ID NO | Antisense Sequence 5' to 3' | SEQ ID NO | Antisense source (on NM_000064.4) |
|---|---|---|---|---|---|
| 1187164 | GUCGGACAAGAAAGGGAUCUA | 915 | UAGAUCCCUUUCUUGUCCGACAU | 1071 | 2486-2508_C1U_as |
| 1187166 | CGGACAAGAAAGGGAUCUGUA | 916 | UACAGAUCCCUUUCUUGUCCGAC | 1072 | 2488-2510_C1U_as |
| 1187167 | GGACAAGAAAGGGAUCUGUGA | 917 | UCACAGAUCCCUUUCUUGUCCGA | 1073 | 2489-2511_A1U_as |
| 1187168 | GACAAGAAAGGGAUCUGUGUA | 918 | UACACAGAUCCCUUUCUUGUCCG | 1074 | 2490-2512_C1U_as |
| 1187169 | ACAAGAAAGGGAUCUGUGUGA | 919 | UCACACAGAUCCCUUUCUUGUCC | 1075 | 2491-2513_C1U_as |
| 1187170 | CAAGAAAGGGAUCUGUGUGGA | 920 | UCCACACAGAUCCCUUUCUUGUC | 1076 | 2492-2514_G1U_as |
| 1187171 | AAGAAAGGGAUCUGUGUGGCA | 921 | UGCCACACAGAUCCCUUUCUUGU | 1077 | 2493-2515_as |
| 1187173 | GAAAGGGAUCUGUGUGGCAGA | 922 | UCUGCCACACAGAUCCCUUUCUU | 1078 | 2495-2517_as |
| 1187230 | CUUCGAGGUCACAGUAAUGCA | 923 | UGCAUUACUGUGACCUCGAAGGG | 1079 | 2519-2541_as |
| 1187231 | UUCGAGGUCACAGUAAUGCAA | 924 | UUGCAUUACUGUGACCUCGAAGG | 1080 | 2520-2542_C1U_as |
| 1187175 | ACAGUAAUGCAGGACUUCUUA | 925 | UAAGAAGUCCUGCAUUACUGUGA | 1081 | 2532-2553_C21A_as |
| 1187176 | AGUAAUGCAGGACUUCUUCAA | 926 | UUGAAGAAGUCCUGCAUUACUGU | 1082 | 2534-2555_as |
| 1187177 | GUAAUGCAGGACUUCUUCAUA | 927 | UAUGAAGAAGUCCUGCAUUACUG | 1083 | 2535-2556_C21A_as |
| 1187268 | GGCUACCCUACUCUGUUGUUA | 928 | UAACAACAGAGUAGGGUAGCCGC | 1084 | 2560-2582_G1U_as |
| 1187270 | CUACCCUACUCUGUUGUUCGA | 929 | UCGAACAACAGAGUAGGGUAGCC | 1085 | 2562-2584_as |
| 1187271 | UACCCUACUCUGUUGUUCGAA | 930 | UUCGAACAACAGAGUAGGGUAGC | 1086 | 2563-2585_as |
| 1187272 | ACCCUACUCUGUUGUUCGAAA | 931 | UUUCGAACAACAGAGUAGGGUAG | 1087 | 2564-2586_as |
| 1187273 | CCCUACUCUGUUGUUCGAAAA | 932 | UUUUCGAACAACAGAGUAGGGUA | 1088 | 2565-2587_G1U_as |
| 1187274 | CCUACUCUGUUGUUCGAAACA | 933 | UGUUUCGAACAACAGAGUAGGGU | 1089 | 2566-2588_C1U_as |
| 1187275 | CUACUCUGUUGUUCGAAACGA | 934 | UCGUUUCGAACAACAGAGUAGGG | 1090 | 2567-2589_as |
| 1187276 | UACUCUGUUGUUCGAAACGAA | 935 | UUCGUUUCGAACAACAGAGUAGG | 1091 | 2568-2590_C1U_as |
| 1187277 | ACUCUGUUGUUCGAAACGAGA | 936 | UCUCGUUUCGAACAACAGAGUAG | 1092 | 2569-2591_G1U_as |
| 1187328 | CUCUGUUGUUCGAAACGAGCA | 937 | UGCUCGUUUCGAACAACAGAGUA | 1093 | 2570-2592_as |
| 1187357 | UCCGAGCCGUUCUCUACAAUA | 938 | UAUUGUAGAGAACGGCUCGGAUU | 1094 | 2599-2621_A1U_as |
| 1187358 | CCGAGCCGUUCUCUACAAUUA | 939 | UAAUUGUAGAGAACGGCUCGGAU | 1095 | 2600-2622_as |
| 1187359 | CGAGCCGUUCUCUACAAUUAA | 940 | UUAAUUGUAGAGAACGGCUCGGA | 1096 | 2601-2623_G1U_as |
| 1187360 | GAGCCGUUCUCUACAAUUACA | 941 | UGUAAUUGUAGAGAACGGCUCGG | 1097 | 2602-2624_G1U_as |
| 1187363 | CCGUUCUCUACAAUUACCGGA | 942 | UCCGGUAAUUGUAGAGAACGGCU | 1098 | 2605-2627_G1U_as |
| 1187456 | GGUGGAACUACUCCACAAUCA | 943 | UGAUUGUGGAGUAGUUCCACCCU | 1099 | 2648-2670_G1U_as |
| 1187859 | AACAAAACUGUGGCUGUUCGA | 944 | UCGAACAGCCACAGUUUUGUUCA | 1100 | 2874-2896_G1U_as |
| 1188032 | CCGAGUCUGAGACCAGAAUUA | 945 | UAAUUCUGGUCUCAGACUCGGUG | 1101 | 2983-3004_C21A_as |
| 1188253 | GGUCAUCGCUGUGCAUUACCA | 946 | UGGUAAUGCACAGCGAUGACCGU | 1102 | 3122-3144_A1U_as |
| 1188254 | GUCAUCGCUGUGCAUUACCUA | 947 | UAGGUAAUGCACAGCGAUGACCG | 1103 | 3123-3145_C1U_as |
| 1188263 | GUGCAUUACCUGGAUGAAACA | 948 | UGUUUCAUCCAGGUAAUGCACAG | 1104 | 3132-3154_C1U_as |
| 1188264 | UGCAUUACCUGGAUGAAACGA | 949 | UCGUUUCAUCCAGGUAAUGCACA | 1105 | 3133-3155_C1U_as |
| 1188540 | CUACGUGGUCAAGGUCUUCUA | 950 | UAGAAGACCUUGACCACGUAGGC | 1106 | 3299-3321_G1U_as |
| 580088 | CGUGGUCAAGGUCUUCUCUCA | 951 | UGAGAGAAGACCUUGACCACGUA | 1107 | 3305-3326_as |
| 1188582 | CGUGAUACACCAAGAAAUGAA | 952 | UUCAUUUCUUGGUGUAUCACGGG | 1108 | 3431-3452_as |

-continued

| Duplex | Sense Sequence 5' to 3' | SEQ ID NO | Antisense Sequence 5' to 3' | SEQ ID NO | Antisense source (on NM_000064.4) |
|---|---|---|---|---|---|
| 1188690 | CGGCCUUUGUUCUCAUCUCGA | 953 | UCGAGAUGAGAACAAAGGCCGUG | 1109 | 3490-3512_G1U_as |
| 1188691 | GGCCUUUGUUCUCAUCUCGCA | 954 | UGCGAGAUGAGAACAAAGGCCGU | 1110 | 3491-3513_A1U_as |
| 1188692 | GCCUUUGUUCUCAUCUCGCUA | 955 | UAGCGAGAUGAGAACAAAGGCCG | 1111 | 3492-3514_C1U_as |
| 1188779 | GACUUCCUUGAAGCCAACUAA | 956 | UUAGUUGGCUUCAAGGAAGUCUC | 1112 | 3579-3601_G1U_as |
| 1188782 | UUCCUUGAAGCCAACUACAUA | 957 | UAUGUAGUUGGCUUCAAGGAAGU | 1113 | 3582-3604_C1U_as |
| 1188790 | AAGCCAACUACAUGAACCUAA | 958 | UUAGGUUCAUGUAGUUGGCUUCA | 1114 | 3589-3611_G1U_as |
| 1188791 | AGCCAACUACAUGAACCUACA | 959 | UGUAGGUUCAUGUAGUUGGCUUC | 1115 | 3590-3612_as |
| 1188793 | CAACUACAUGAACCUACAGAA | 960 | UUCUGUAGGUUCAUGUAGUUGGC | 1116 | 3593-3615_C1U_as |
| 1188857 | GCCUCUUCUUAACAAAUUUCA | 961 | UGAAAUUUGUUAAGAAGAGGCCC | 1117 | 3671-3693_A1U_as |
| 1188870 | UUCUGACCACAGCCAAAGAUA | 962 | UAUCUUUGGCUGUGGUCAGAAAU | 1118 | 3688-3710_as |
| 1188876 | CCACAGCCAAAGAUAAGAACA | 963 | UGUUCUUAUCUUUGGCUGUGGUC | 1119 | 3694-3716_G1U_as |
| 1188962 | CUACUGCAGCUAAAAGACUUA | 964 | UAAGUCUUUUAGCUGCAGUAGGG | 1120 | 3777-3799_A1U_as |
| 1188966 | UGCAGCUAAAAGACUUUGACA | 965 | UGUCAAAGUCUUUUAGCUGCAGU | 1121 | 3781-3803_A1U_as |
| 1188995 | UCGUGCGUUGGCUCAAUGAAA | 966 | UUUCAUUGAGCCAACGCACGACG | 1122 | 3814-3836_G1U_as |
| 1188996 | CGUGCGUUGGCUCAAUGAACA | 967 | UGUUCAUUGAGCCAACGCACGAC | 1123 | 3815-3837_as |
| 1188997 | GUGCGUUGGCUCAAUGAACAA | 968 | UUGUUCAUUGAGCCAACGCACGA | 1124 | 3816-3838_C1U_as |
| 1189008 | CAAUGAACAGAGAUACUACGA | 969 | UCGUAGUAUCUCUGUUCAUUGAG | 1125 | 3827-3849_C1U_as |
| 1189009 | AAUGAACAGAGAUACUACGGA | 970 | UCCGUAGUAUCUCUGUUCAUUGA | 1126 | 3828-3850_A1U_as |
| 1189010 | AUGAACAGAGAUACUACGGUA | 971 | UACCGUAGUAUCUCUGUUCAUUG | 1127 | 3829-3851_C1U_as |
| 1189057 | UUCAUGGUGUUCCAAGCCUUA | 972 | UAAGGCUUGGAACACCAUGAAGG | 1128 | 3876-3898_C1U_as |
| 1189068 | CCAAGCCUUGGCUCAAUACCA | 973 | UGGUAUUGAGCCAAGGCUUGGAA | 1129 | 3887-3909_as |
| 1189069 | CAAGCCUUGGCUCAAUACCAA | 974 | UUGGUAUUGAGCCAAGGCUUGGA | 1130 | 3888-3910_as |
| 1189071 | AGCCUUGGCUCAAUACCAAAA | 975 | UUUUGGUAUUGAGCCAAGGCUUG | 1131 | 3890-3912_as |
| 1189144 | CCACCGUAUCCACUGGGAAUA | 976 | UAUUCCCAGUGGAUACGGUGGGU | 1132 | 3983-4005_G1U_as |
| 1189175 | CUGCGAUCAGAAGAGACCAAA | 977 | UUUGGUCUCUUCUGAUCGCAGGA | 1133 | 4014-4036_C1U_as |
| 1189176 | UGCGAUCAGAAGAGACCAAGA | 978 | UCUUGGUCUCUUCUGAUCGCAGG | 1134 | 4015-4037_C1U_as |
| 1189189 | CCAAGGAAAAUGAGGGUUUCA | 979 | UGAAACCCUCAUUUUCCUUGGUC | 1135 | 4030-4052_as |
| 1189191 | AAGGAAAAUGAGGGUUUCACA | 980 | UGUGAAACCCUCAUUUUCCUUGG | 1136 | 4032-4054_as |
| 1189284 | AACUCACCUGUAAUAAAUUCA | 981 | UGAAUUUAUUACAGGUGAGUUGA | 1137 | 4123-4145_C1U_as |
| 1189285 | ACUCACCUGUAAUAAAUUCGA | 982 | UCGAAUUUAUUACAGGUGAGUUG | 1138 | 4124-4146_as |
| 1189248 | CUCACCUGUAAUAAAUUCGAA | 983 | UUCGAAUUUAUUACAGGUGAGUU | 1139 | 4128-4149_C21A_as |
| 1189288 | ACCUGUAAUAAAUUCGACCUA | 984 | UAGGUCGAAUUUAUUACAGGUGA | 1140 | 4128-4150_G1U_as |
| 1189249 | CCUGUAAUAAAUUCGACCUCA | 985 | UGAGGUCGAAUUUAUUACAGGUG | 1141 | 4132-4153_as |
| 1189289 | CUGUAAUAAAUUCGACCUCAA | 986 | UUGAGGUCGAAUUUAUUACAGGU | 1142 | 4130-4152_as |
| 1189292 | UAAUAAAUUCGACCUCAAGGA | 987 | UCCUUGAGGUCGAAUUUAUUACA | 1143 | 4133-4155_A1U_as |
| 1189302 | GACCUCAAGGUCACCAUAAAA | 988 | UUUUAUGGUGACCUUGAGGUCGA | 1144 | 4143-4165_as |
| 1189303 | ACCUCAAGGUCACCAUAAAAA | 989 | UUUUUAUGGUGACCUUGAGGUCG | 1145 | 4144-4166_G1U_as |

-continued

| Duplex | Sense Sequence 5' to 3' | SEQ ID NO | Antisense Sequence 5' to 3' | SEQ ID NO | Antisense source (on NM_000064.4) |
|---|---|---|---|---|---|
| 1189304 | CCUCAAGGUCACCAUAAAACA | 990 | UGUUUUAUGGUGACCUUGAGGUC | 1146 | 4145-4167_G1U_as |
| 1189305 | CUCAAGGUCACCAUAAAACCA | 991 | UGGUUUUAUGGUGACCUUGAGGU | 1147 | 4146-4168_as |
| 1189306 | UCAAGGUCACCAUAAAACCAA | 992 | UUGGUUUUAUGGUGACCUUGAGG | 1148 | 4147-4169_C1U_as |
| 1189351 | AGGAUGCCAAGAACACUAUGA | 993 | UCAUAGUGUUCUUGGCAUCCUGA | 1149 | 4192-4214_as |
| 1189353 | GAUGCCAAGAACACUAUGAUA | 994 | UAUCAUAGUGUUCUUGGCAUCCU | 1150 | 4194-4216_G1U_as |
| 1189387 | AGGAUGCCACUAUGUCUAUAA | 995 | UUAUAGACAUAGUGGCAUCCUGG | 1151 | 4246-4268_A1U_as |
| 1189480 | CAGAUACAUCUCCAAGUAUGA | 996 | UCAUACUUGGAGAUGUAUCUGUC | 1152 | 4337-4359_as |
| 1189501 | UGGACAAAGCCUUCUCCGAUA | 997 | UAUCGGAGAAGGCUUUGUCCAGC | 1153 | 4360-4382_as |
| 1189522 | AGGAACACCCUCAUCAUCUAA | 998 | UUAGAUGAUGAGGGUGUUCCUAU | 1154 | 4380-4402_G1U_as |
| 1189503 | GGAACACCCUCAUCAUCUACA | 999 | UGUAGAUGAUGAGGGUGUUCCUA | 1155 | 4384-4405_C21A_as |
| 1189524 | AACACCCUCAUCAUCUACCUA | 1000 | UAGGUAGAUGAUGAGGGUGUUCC | 1156 | 4383-4405_C1U_as |
| 1189576 | UCUAGCUUUCAAAGUUCACCA | 1001 | UGGUGAACUUUGAAAGCUAGACA | 1157 | 4433-4455_as |
| 1189577 | CUAGCUUUCAAAGUUCACCAA | 1002 | UUGGUGAACUUUGAAAGCUAGAC | 1158 | 4434-4456_as |
| 1189598 | CUUUAAUGUAGAGCUUAUCCA | 1003 | UGGAUAAGCUCUACAUUAAAGUA | 1159 | 4457-4479_as |
| 1189599 | UUUAAUGUAGAGCUUAUCCAA | 1004 | UUGGAUAAGCUCUACAUUAAAGU | 1160 | 4458-4480_C1U_as |
| 1189628 | AGUCAAGGUCUACGCCUAUUA | 1005 | UAAUAGGCGUAGACCUUGACUGC | 1161 | 4487-4509_as |
| 1189630 | UCAAGGUCUACGCCUAUUACA | 1006 | UGUAAUAGGCGUAGACCUUGACU | 1162 | 4489-4511_as |
| 1189631 | CAAGGUCUACGCCUAUUACAA | 1007 | UUGUAAUAGGCGUAGACCUUGAC | 1163 | 4490-4512_as |
| 1189632 | AAGGUCUACGCCUAUUACAAA | 1008 | UUUGUAAUAGGCGUAGACCUUGA | 1164 | 4491-4513_G1U_as |
| 1189633 | AGGUCUACGCCUAUUACAACA | 1009 | UGUUGUAAUAGGCGUAGACCUUG | 1165 | 4492-4514_G1U_as |
| 1189635 | GUCUACGCCUAUUACAACCUA | 1010 | UAGGUUGUAAUAGGCGUAGACCU | 1166 | 4494-4516_C1U_as |
| 1189636 | UCUACGCCUAUUACAACCUGA | 1011 | UCAGGUUGUAAUAGGCGUAGACC | 1167 | 4495-4517_C1U_as |
| 1189817 | GGAGUGGACUAUGUGUACAAA | 1012 | UUUGUACACAUAGUCCACUCCUG | 1168 | 4677-4699_C1U_as |
| 1189819 | AGUGGACUAUGUGUACAAGAA | 1013 | UUCUUGUACACAUAGUCCACUCC | 1169 | 4679-4701_G1U_as |
| 1189820 | GUGGACUAUGUGUACAAGACA | 1014 | UGUCUUGUACACAUAGUCCACUC | 1170 | 4680-4702_G1U_as |
| 1189811 | UGGACUAUGUGUACAAGACCA | 1015 | UGGUCUUGUACACAUAGUCCACU | 1171 | 4684-4705_C21A_as |
| 1189856 | AGCUGUCCAAUGACUUUGACA | 1016 | UGUCAAAGUCAUUGGACAGCUGA | 1172 | 4717-4739_C1U_as |
| 1189857 | GCUGUCCAAUGACUUUGACGA | 1017 | UCGUCAAAGUCAUUGGACAGCUG | 1173 | 4718-4740_as |
| 1190061 | GAGAACCAGAAACAAUGCCAA | 1018 | UUGGCAUUGUUUCUGGUUCUCUU | 1174 | 4980-5002_C1U_as |
| 1190101 | AGCAUGGUUGUCUUUGGGUGA | 1019 | UCACCCAAAGACAACCAUGCUCU | 1175 | 5022-5044_G1U_as |

TABLE 9

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 580084 | gsusggu(Chd) AfaGfGfUfcuu cucucsusa | 1176 | VPusAfsgagAf gAfAfgaccUfu Gfaccacsgsu | 1333 | GUGGUCAAGGUC UUCUCUCUA | 1490 |

TABLE 9-continued

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 580087 | usasccu(Chd) UfuCfAfUfcca gacagsasa | 1177 | VPusUfscugUf cUfGfgaugAfa Gfagguascsc | 1334 | UACCUCUUCAUC CAGACAGAA | 1491 |
| 580089 | cscsaga(Uhd) CfcAfCfUfuca ccaagsasa | 1178 | VPusUfscuuGf gUfGfaaguGfg Afucuggsusa | 1335 | CCAGAUCCACUU CACCAAGAA | 1492 |
| 1184757 | csgsggu(Ahd) CfcUfCfUfuca uccagsasa | 1179 | VPusUfscugGf aUfGfaagaGfg Ufacccgscsu | 1336 | CGGGUACCUCUU CAUCCAGAC | 1493 |
| 1184761 | gsusacc(Uhd) CfuUfCfAfucc agacasgsa | 1180 | VPusCfsuguCf uGfGfaugaAfg Afgguacscsc | 1337 | GUACCUCUUCAU CCAGACAGA | 1494 |
| 1184769 | csasucc(Ahd) GfaCfAfGfaca agaccsasa | 1181 | VPusUfsgguCf uUfGfucugUfc Ufggaugsasa | 1338 | CAUCCAGACAGA CAAGACCAU | 1495 |
| 1184772 | cscsaga(Chd) AfgAfCfAfaga ccaucsusa | 1182 | VPusAfsgauGf gUfCfuuguCfu Gfucuggsasu | 1339 | CCAGACAGACAA GACCAUCUA | 1496 |
| 1184774 | asgsaca(Ghd) AfcAfAfGfacc aucuascsa | 1183 | VPusGfsuagAf uGfGfucuuGfu Cfugucusgsg | 1340 | AGACAGACAAGA CCAUCUACA | 1497 |
| 1184775 | ascsaga(Chd) AfaGfAfCfcau cuacascsa | 1184 | VPusGfsuguAf gAfUfggucUfu Gfucuguscsu | 1341 | ACAGACAAGACC AUCUACACC | 1498 |
| 1184760 | gsascag(Ahd) CfaAfGfAfcca ucuacsasa | 1185 | VPusUfsguaGf aUfGfgucuUfg Ufcugucsusg | 1342 | GACAGACAAGAC CAUCUACAC | 1499 |
| 1184831 | ascsggu(Chd) AfuGfGfUfcaa cauugsasa | 1186 | VPusUfscaaUf gUfUfgaccAfu Gfaccguscsc | 1343 | ACGGUCAUGGUC AACAUUGAG | 1500 |
| 1184924 | usgsgga(Chd) AfuUfCfCfgga acucgsusa | 1187 | VPusAfscgaGf uUfCfcggaAfu Gfucccasasg | 1344 | UGGGACAUUCCG GAACUCGUC | 1501 |
| 1184930 | asusucc(Ghd) GfaAfCfUfcgu caacasusa | 1188 | VPusAfsuguUf gAfCfgaguUfc Cfggaausgsu | 1345 | AUUCCGGAACUC GUCAACAUG | 1502 |
| 1184961 | asgsauc(Chd) GfaGfCfCfuac uaugasasa | 1189 | VPusUfsucaUf aGfUfaggcUfc Gfgaucusus c | 1346 | AGAUCCGAGCCU ACUAUGAAA | 1503 |
| 1184962 | gsasucc(Ghd) AfgCfCfUfacu augaasasa | 1190 | VPusUfsuucAf uAfGfuaggCfu Cfggaucsusu | 1347 | GAUCCGAGCCUA CUAUGAAAA | 1504 |
| 1184992 | gscsagg(Uhd) CfuUfCfUfcca cugagsusa | 1191 | VPusAfscucAf gUfGfgagaAfg Afccugcsusg | 1348 | GCAGGUCUUCUC CACUGAGUU | 1505 |
| 1185004 | csascug(Ahd) GfuUfUfGfagg ugaagsgsa | 1192 | VPusCfscuuCf aCfCfucaaAfc Ufcagugsgsa | 1349 | CACUGAGUUUGA GGUGAAGGA | 1506 |
| 1185005 | ascsuga(Ghd) UfuUfGfAfggu gaaggsasa | 1193 | VPusUfsccuUf cAfCfcucaAfa Cfucagusgsg | 1350 | ACUGAGUUUGAG GUGAAGGAG | 1507 |
| 1185036 | gscscca(Ghd) UfuUfCfGfagg ucauasgsa | 1194 | VPusCfsuauGf aCfCfucgaAfa Cfugggcsasg | 1351 | GCCCAGUUUCGA GGUCAUAGU | 1508 |

TABLE 9-continued

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 1185038 | cscsagu(Uhd) UfcGfAfGfguc auagusgsa | 1195 | VPusCfsacuAf uGfAfccucGfa Afacuggsgsc | 1352 | CCAGUUUCGAGG UCAUAGUGG | 1509 |
| 1185064 | asasuuc(Uhd) AfcUfAfCfauc uauaascsa | 1196 | VPusGfsuuaUf aGfAfuguaGfu Afgaauusuc | 1353 | AAUUCUACUACA UCUAUAACG | 1510 |
| 1185147 | ascsugc(Chd) UfuUfGfUfcau cuucgsgsa | 1197 | VPusCfscgaAf gAfUfgacaAfa Gfgcagususc | 1354 | ACUGCCUUUGUC AUCUUCGGG | 1511 |
| 1185307 | uscsccu(Ahd) CfcAfGfAfucc acuucsasa | 1198 | VPusUfsgaaGf uGfGfaucuGfg Ufagggasgsa | 1355 | UCCCUACCAGAU CCACUUCAC | 1512 |
| 1185308 | cscscua(Chd) CfaGfAfUfcca cuucascsa | 1199 | VPusGfsugaAf gUfGfgaucUfg Gfuagggsasg | 1356 | CCCUACCAGAUC CACUUCACC | 1513 |
| 1185310 | csusacc(Ahd) GfaUfCfCfacu ucaccsasa | 1200 | VPusUfsgguGf aAfGfuggaUfc Ufgguagsgsg | 1357 | CUACCAGAUCCA CUUCACCAA | 1514 |
| 1185311 | usascca(Ghd) AfuCfCfAfcuu caccasasa | 1201 | VPusUfsuggUf gAfAfguggAfu Cfugguasgsg | 1358 | UACCAGAUCCAC UUCACCAAG | 1515 |
| 1185367 | csuscau(Ghd) GfuGfUfUfcgu gacgasasa | 1202 | VPusUfsucgUf cAfCfgaacAfc Cfaugagsgsu | 1359 | CUCAUGGUGUUC GUGACGAAC | 1516 |
| 1185559 | usgsggc(Ahd) AfcUfCfCfaac aauuascsa | 1203 | VPusGfsuaaUf uGfUfuggaGfu Ufgcccascsg | 1360 | UGGGCAACUCCA ACAAUUACC | 1517 |
| 1185560 | gsgsgca(Ahd) CfuCfCfAfaca auuacscsa | 1204 | VPusGfsguaAf uUfGfuuggAfg Ufugcccsasc | 1361 | GGGCAACUCCAA CAAUUACCU | 1518 |
| 1185561 | gsgscaa(Chd) UfcCfAfAfcaa uuaccsusa | 1205 | VPusAfsgguAf aUfUfguugGfa Gfuugccscsa | 1362 | GGCAACUCCAAC AAUUACCUG | 1519 |
| 1185562 | gscsaac(Uhd) CfcAfAfCfaau uaccusgsa | 1206 | VPusCfsaggUf aAfUfuguuGfg Afguugcscsc | 1363 | GCAACUCCAACA AUUACCUGC | 1520 |
| 1185563 | csasacu(Chd) CfaAfCfAfauu accugscsa | 1207 | VPusGfscagGf uAfAfuuguUfg Gfaguugscsc | 1364 | CAACUCCAACAA UUACCUGCA | 1521 |
| 1185567 | csasaca(Ahd) UfuAfCfCfugc aucucsusa | 1208 | VPusAfsgagAf uGfCfagguAfa Ufuguugsgsa | 1365 | CAACAAUUACCU GCAUCUCUC | 1522 |
| 1185612 | gsuscaa(Chd) UfuCfCfUfccu gcgaasusa | 1209 | VPusAfsuucGf cAfGfgaggAfa Gfuugacsgsu | 1366 | GUCAACUUCCUC CUGCGAAUG | 1523 |
| 1185644 | csasaga(Uhd) CfcGfCfUfacu acaccsusa | 1210 | VPusAfsgguGf uAfGfuagcGfg Afucuugsgsc | 1367 | CAAGAUCCGCUA CUACACCUA | 1524 |
| 1186177 | csgsugu(Uhd) CfgUfGfCfuga auaagsasa | 1211 | VPusUfscuuAf uUfCfagcaCfg Afacacgscsc | 1368 | CGUGUUCGUGCU GAAUAAGAA | 1525 |
| 1186179 | usgsuuc(Ghd) UfgCfUfGfaau aagaasgsa | 1212 | VPusCfsuucUf uAfUfucagCfa Cfgaacascsg | 1369 | UGUUCGUGCUGA AUAAGAAGA | 1526 |

TABLE 9-continued

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 1186180 | gsusucg(Uhd) GfcUfGfAfaua agaagsasa | 1213 | VPusUfscuuCf uUfAfuucaGfc Afcgaacsasc | 1370 | GUUCGUGCUGAA UAAGAAGAA | 1527 |
| 1186181 | ususcgu(Ghd) CfuGfAfAfuaa gaagasasa | 1214 | VPusUfsucuUf cUfUfauucAfg Cfacgaascsa | 1371 | UUCGUGCUGAAU AAGAAGAAC | 1528 |
| 1186183 | csgsugc(Uhd) GfaAfUfAfaga agaacsasa | 1215 | VPusUfsguuCf uUfCfuuauUfc Afgcacgsasa | 1372 | CGUGCUGAAUAA GAAGAACAA | 1529 |
| 1186184 | gsusgcu(Ghd) AfaUfAfAfgaa gaacasasa | 1216 | VPusUfsuguUf cUfUfcuuaUfu Cfagcacgsgsa | 1373 | GUGCUGAAUAAG AAGAACAAA | 1530 |
| 1186190 | asasuaa(Ghd) AfaGfAfAfcaa acugascsa | 1217 | VPusGfsucaGf uUfUfguucUfu Cfuuauuscsa | 1374 | AAUAAGAAGAAC AAACUGACG | 1531 |
| 1186202 | asascug(Ahd) CfgCfAfGfagu aagauscsa | 1218 | VPusGfsaucUf uAfCfucugCfg Ufcaguusg | 1375 | AACUGACGCAGA GUAAGAUCU | 1532 |
| 1186203 | ascsuga(Chd) GfcAfGfAfgua agaucsusa | 1219 | VPusAfsgauCf uUfAfcucuGfc Gfucagusu | 1376 | ACUGACGCAGAG UAAGAUCUG | 1533 |
| 1186771 | usgscag(Ahd) AfgAfGfAfaca ucguusa | 1220 | VPusAfsaacGf aUfGfuucuCfu Ufcugcasasu | 1377 | UGCAGAAGAGAA CAUCGUUUC | 1534 |
| 1186866 | gsasaga(Ghd) AfaCfAfUfcgu uucccsgsa | 1221 | VPusCfsgggAf aAfCfgaugUfu Cfucuucsusg | 1378 | GAAGAGAACAUC GUUUCCCGA | 1535 |
| 1186867 | asasgag(Ahd) AfcAfUfCfguu ucccgsasa | 1222 | VPusUfscggGf aAfAfcgauGfu Ufcucuuscsu | 1379 | AAGAGAACAUCG UUUCCCGAA | 1536 |
| 1186870 | asgsaac(Ahd) UfcGfUfUfucc cgaagsusa | 1223 | VPusAfscuuCf gGfGfaaacGfa Ufguucuscsu | 1380 | AGAACAUCGUUU CCCGAAGUG | 1537 |
| 1186871 | gsasaca(Uhd) CfgUfUfUfccc gaagusgsa | 1224 | VPusCfsacuUf cGfGfgaaaCfg Afuguucsusc | 1381 | GAACAUCGUUUC CCGAAGUGA | 1538 |
| 1186922 | asascau(Chd) GfuUfUfCfccg aagugsasa | 1225 | VPusUfscacUf uCfGfggaaAfc Gfauguuscsu | 1382 | AACAUCGUUUCC CGAAGUGAG | 1539 |
| 1187161 | csasugu(Chd) GfgAfCfAfaga aagggsasa | 1226 | VPusUfscccUf uUfCfuuguCfc Gfacaugscsu | 1383 | CAUGUCGGACAA GAAAGGGAU | 1540 |
| 1187162 | asusguc(Ghd) GfaCfAfAfgaa agggasusa | 1227 | VPusAfsuccCf uUfUfcuugUfc Cfgacausgsc | 1384 | AUGUCGGACAAG AAAGGGAUC | 1541 |
| 1187164 | gsuscgg(Ahd) CfaAfGfAfaag ggaucsusa | 1228 | VPusAfsgauCf cCfUfuucuUfg Ufccgacsasu | 1385 | GUCGGACAAGAA AGGGAUCUG | 1542 |
| 1187166 | csgsgac(Ahd) AfgAfAfAfggg aucugsusa | 1229 | VPusAfscagAf uCfCfcuuuCfu Ufguccgsasc | 1386 | CGGACAAGAAAG GGAUCUGUG | 1543 |
| 1187167 | gsgsaca(Ahd) GfaAfAfGfgga ucugusgsa | 1230 | VPusCfsacaGf aUfCfccuuUfc Ufuguccgsgsa | 1387 | GGACAAGAAAGG GAUCUGUGU | 1544 |

TABLE 9-continued

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 1187168 | gsascaa(Ghd) AfaAfGfGfgau cugugsusa | 1231 | VPusAfscacAf gAfUfcccuUfu Cfuugucscsg | 1388 | GACAAGAAAGGG AUCUGUGUG | 1545 |
| 1187169 | ascsaag(Ahd) AfaGfGfGfauc ugugusgsa | 1232 | VPusCfsacaCf aGfAfucccUfu Ufcuuguscsc | 1389 | ACAAGAAAGGGA UCUGUGUGG | 1546 |
| 1187170 | csasaga(Ahd) AfgGfGfAfucu gugugsgsa | 1233 | VPusCfscacAf cAfGfauccCfu Ufucuugsusc | 1390 | CAAGAAAGGGAU CUGUGUGGC | 1547 |
| 1187171 | asasgaa(Ahd) GfgGfAfUfcug uguggscsa | 1234 | VPusGfsccaCf aCfAfgaucCfc Ufuucuusgsu | 1391 | AAGAAAGGGAUC UGUGUGGCA | 1548 |
| 1187173 | gsasaag(Ghd) GfaUfCfUfgug uggcasgsa | 1235 | VPusCfsugcCf aCfAfcagaUfc Cfcuuucsusu | 1392 | GAAAGGGAUCUG UGUGGCAGA | 1549 |
| 1187230 | csusucg(Ahd) GfgUfCfAfcag uaaugscsa | 1236 | VPusGfscauUf aCfUfgugaCfc Ufcgaagsgsg | 1393 | CUUCGAGGUCAC AGUAAUGCA | 1550 |
| 1187231 | ususcga(Ghd) GfuCfAfCfagu aaugcsasa | 1237 | VPusUfsgcaUf uAfCfugugAfc Cfucgaasgsg | 1394 | UUCGAGGUCACA GUAAUGCAG | 1551 |
| 1187175 | ascsagu(Ahd) AfuGfCfAfgga cuucususa | 1238 | VPusAfsagaAf gUfCfcugcAfu Ufacugusgsa | 1395 | ACAGUAAUGCAG GACUUCUUC | 1552 |
| 1187176 | asgsuaa(Uhd) GfcAfGfGfacu ucuucsasa | 1239 | VPusUfsgaaGf aAfGfuccuGfc Afuuacusgsu | 1396 | AGUAAUGCAGGA CUUCUUCAU | 1553 |
| 1187177 | gsusaau(Ghd) CfaGfGfAfcuu cuucasusa | 1240 | VPusAfsugaAf gAfAfguccUfg Cfauuacsusg | 1397 | GUAAUGCAGGAC UUCUUCAUC | 1554 |
| 1187268 | gsgscua(Chd) CfcUfAfCfucu guugususa | 1241 | VPusAfsacaAf cAfGfaguaGfg Gfuagccsgsc | 1398 | GGCUACCCUACU CUGUUGUUC | 1555 |
| 1187270 | csusacc(Chd) UfaCfUfCfugu uguucsgsa | 1242 | VPusCfsgaaCf aAfCfagagUfa Gfgguagscsc | 1399 | CUACCCUACUCU GUUGUUCGA | 1556 |
| 1187271 | usasccc(Uhd) AfcUfCfUfguu guucgsasa | 1243 | VPusUfscgaAf cAfAfcagaGfu Afggguasgsc | 1400 | UACCCUACUCUG UUGUUCGAA | 1557 |
| 1187272 | ascsccu(Ahd) CfuCfUfGfuug uucgasasa | 1244 | VPusUfsucgAf aCfAfacagAfg Ufagggusasg | 1401 | ACCCUACUCUGU UGUUCGAAA | 1558 |
| 1187273 | cscscua(Chd) UfcUfGfUfugu ucgaasasa | 1245 | VPusUfsuucGf aAfCfaacaGfa Gfuagggsusa | 1402 | CCCUACUCUGUU GUUCGAAAC | 1559 |
| 1187274 | cscsuac(Uhd) CfuGfUfUfguu cgaaascsa | 1246 | VPusGfsuuuCf gAfAfcaacAfg Afguaggsgsu | 1403 | CCUACUCUGUUG UUCGAAACG | 1560 |
| 1187275 | csusacu(Chd) UfgUfUfGfuuc gaaacsgsa | 1247 | VPusCfsguuUf cGfAfacaaCfa Gfaguagsgsg | 1404 | CUACUCUGUUGU UCGAAACGA | 1561 |
| 1187276 | usascuc(Uhd) GfuUfGfUfucg aaacgsasa | 1248 | VPusUfscguUf uCfGfaacaAfc Afgaguasgsg | 1405 | UACUCUGUUGUU CGAAACGAG | 1562 |

TABLE 9-continued

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 1187277 | ascsucu(Ghd) UfuGfUfUfcga aacgasgsa | 1249 | VPusCfsucgUf uUfCfgaacAfa Cfagagusasg | 1406 | ACUCUGUUGUUC GAAACGAGC | 1563 |
| 1187328 | csuscug(Uhd) UfgUfUfCfgaa acgagscsa | 1250 | VPusGfscucGf uUfUfcgaaCfa Afcagagsusa | 1407 | CUCUGUUGUUCG AAACGAGCA | 1564 |
| 1187357 | uscscga(Ghd) CfcGfUfUfcuc uacaasusa | 1251 | VPusAfsuugUf aGfAfgaacGfg Cfucggasusu | 1408 | UCCGAGCCGUUC UCUACAAUU | 1565 |
| 1187358 | cscsgag(Chd) CfgUfUfCfucu acaaususa | 1252 | VPusAfsauuGf uAfGfagaaCfg Gfcucggsasu | 1409 | CCGAGCCGUUCU CUACAAUUA | 1566 |
| 1187359 | csgsagc(Chd) GfuUfCfUfcua caauusasa | 1253 | VPusUfsaauUf gUfAfgagaAfc Gfgcucgsgsa | 1410 | CGAGCCGUUCUC UACAAUUAC | 1567 |
| 1187360 | gsasgcc(Ghd) UfuCfUfCfuac aauuascsa | 1254 | VPusGfsuaaUf uGfUfagagAfa Cfggcucsgsg | 1411 | GAGCCGUUCUCU ACAAUUACC | 1568 |
| 1187363 | cscsguu(Chd) UfcUfAfCfaau uaccgsgsa | 1255 | VPusCfscggUf aAfUfuguaGfa Gfaacggscsu | 1412 | CCGUUCUCUACA AUUACCGGC | 1569 |
| 1187456 | gsgsugg(Ahd) AfcUfAfCfucc acaauscsa | 1256 | VPusGfsauuGf uGfGfaguaGfu Ufccaccscsu | 1413 | GGUGGAACUACU CCACAAUCC | 1570 |
| 1187859 | asascaa(Ahd) AfcUfGfUfggc uguucsgsa | 1257 | VPusCfsgaaCf aGfCfcacaGfu Ufuuguuscsa | 1414 | AACAAAACUGUG GCUGUUCGC | 1571 |
| 1188032 | cscsgag(Uhd) CfuGfAfGfacc agaaususa | 1258 | VPusAfsauuCf uGfGfucucAfg Afcucggsusg | 1415 | CCGAGUCUGAGA CCAGAAUUC | 1572 |
| 1188253 | gsgsuca(Uhd) CfgCfUfGfugc auuacscsa | 1259 | VPusGfsguaAf uGfCfacagCfg Afugaccsgsu | 1416 | GGUCAUCGCUGU GCAUUACCU | 1573 |
| 1188254 | gsuscau(Chd) GfcUfGfUfgca uuaccsusa | 1260 | VPusAfsgguAf aUfGfcacaGfc Gfaugacscsg | 1417 | GUCAUCGCUGUG CAUUACCUG | 1574 |
| 1188263 | gsusgca(Uhd) UfaCfCfUfgga ugaaascsa | 1261 | VPusGfsuuuCf aUfCfcaggUfa Afugcacsasg | 1418 | GUGCAUUACCUG GAUGAAACG | 1575 |
| 1188264 | usgscau(Uhd) AfcCfUfGfgau gaaacsgsa | 1262 | VPusCfsguuUf cAfUfccagGfu Afaugcascsa | 1419 | UGCAUUACCUGG AUGAAACGG | 1576 |
| 1188540 | csusacg(Uhd) GfgUfCfAfagg ucuucsusa | 1263 | VPusAfsgaaGf aCfCfuugaCfc Afcguagsgsc | 1420 | CUACGUGGUCAA GGUCUUCUC | 1577 |
| 580088 | csgsugg(Uhd) CfaAfGfGfucu ucucuscsa | 1264 | VPusGfsagaGf aAfGfaccuUfg Afccacgsusa | 1421 | CGUGGUCAAGGU CUUCUCUCA | 1578 |
| 1188582 | csgsuga(Uhd) AfcAfCfCfaag aaaugsasa | 1265 | VPusUfscauUf uCfUfugguGfu Afucacgsgsg | 1422 | CGUGAUACACCA AGAAAUGAU | 1579 |
| 1188690 | csgsgcc(Uhd) UfuGfUfUfcuc aucucgsa | 1266 | VPusCfsgagAf uGfAfgaacAfa Afggccgsusg | 1423 | CGGCCUUUGUUC UCAUCUCGC | 1580 |

TABLE 9-continued

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 1188691 | gsgsccu(Uhd) UfgUfUfCfuca ucucgscsa | 1267 | VPusGfscgaGf aUfGfagaaCfa Afaggccsgsu | 1424 | GGCCUUUGUUCU CAUCUCGCU | 1581 |
| 1188692 | gscscuu(Uhd) GfuUfCfUfcau cucgcsusa | 1268 | VPusAfsgcgAf gAfUfgagaAfc Afaaggcscsg | 1425 | GCCUUUGUUCUC AUCUCGCUG | 1582 |
| 1188779 | gsascuu(Chd) CfuUfGfAfagc caacusasa | 1269 | VPusUfsaguUf gGfCfuucaAfg Gfaagucsusc | 1426 | GACUUCCUUGAA GCCAACUAC | 1583 |
| 1188782 | ususccu(Uhd) GfaAfGfCfcaa cuacasusa | 1270 | VPusAfsuguAf gUfUfggcuUfc Afaggaasgsu | 1427 | UUCCUUGAAGCC AACUACAUG | 1584 |
| 1188790 | asasgcc(Ahd) AfcUfAfCfaug aaccusasa | 1271 | VPusUfsaggUf uCfAfuguaGfu Ufggcuuscsa | 1428 | AAGCCAACUACA UGAACCUAC | 1585 |
| 1188791 | asgscca(Ahd) CfuAfCfAfuga accuascsa | 1272 | VPusGfsuagGf uUfCfauguAfg Ufuggcusc | 1429 | AGCCAACUACAU GAACCUACA | 1586 |
| 1188793 | csasacu(Ahd) CfaUfGfAfacc uacagsasa | 1273 | VPusUfscugUf aGfGfuucaUfg Ufaguugsgsc | 1430 | CAACUACAUGAA CCUACAGAG | 1587 |
| 1188857 | gscscuc(Uhd) UfcUfUfAfaca aauuuscsa | 1274 | VPusGfsaaaUf uUfGfuuaaGfa Afgaggcscsc | 1431 | GCCUCUUCUUAA CAAAUUUCU | 1588 |
| 1188870 | ususcug(Ahd) CfcAfCfAfgcc aaagasusa | 1275 | VPusAfsucuUf uGfGfcuguGfg Ufcagaasasu | 1432 | UUCUGACCACAG CCAAAGAUA | 1589 |
| 1188876 | cscsaca(Ghd) CfcAfAfAfgau aagaascsa | 1276 | VPusGfsuucUf uAfUfcuuuGfg Cfuguggsusc | 1433 | CCACAGCCAAAG AUAAGAACC | 1590 |
| 1188962 | csusacu(Ghd) CfaGfCfUfaaa agacususa | 1277 | VPusAfsaguCf uUfUfuagcUfg Cfaguagsgsg | 1434 | CUACUGCAGCUA AAAGACUUU | 1591 |
| 1188966 | usgscag(Chd) UfaAfAfAfgac uuugascsa | 1278 | VPusGfsucaAf aGfUfcuuuUfa Gfcugcasgsu | 1435 | UGCAGCUAAAAG ACUUUGACU | 1592 |
| 1188995 | uscsgug(Chd) GfuUfGfGfcuc aaugasasa | 1279 | VPusUfsucaUf uGfAfgccaAfc Gfcacgascsg | 1436 | UCGUGCGUUGGC UCAAUGAAC | 1593 |
| 1188996 | csgsugc(Ghd) UfuGfGfCfuca augaascsa | 1280 | VPusGfsuucAf uUfGfagccAfa Cfgcacgsasc | 1437 | CGUGCGUUGGCU CAAUGAACA | 1594 |
| 1188997 | gsusgcg(Uhd) UfgGfCfUfcaa ugaacsasa | 1281 | VPusUfsguuCf aUfUfgagcCfa Afcgcacsgsa | 1438 | GUGCGUUGGCUC AAUGAACAG | 1595 |
| 1189008 | csasaug(Ahd) AfcAfGfAfgau acuacsgsa | 1282 | VPusCfsguaGf uAfUfcucuGfu Ufcauugsasg | 1439 | CAAUGAACAGAG AUACUACGG | 1596 |
| 1189009 | asasuga(Ahd) CfaGfAfGfaua cuacgsgsa | 1283 | VPusCfscguAf gUfAfucucUfg Ufucauusgsa | 1440 | AAUGAACAGAGA UACUACGGU | 1597 |
| 1189010 | asusgaa(Chd) AfgAfGfAfuac uacggsusa | 1284 | VPusAfsccgUf aGfUfaucuCfu Gfuucausus g | 1441 | AUGAACAGAGAU ACUACGGUG | 1598 |

TABLE 9-continued

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 1189057 | ususcau(Ghd) GfuGfUfUfcca agccususa | 1285 | VPusAfsaggCf uUfGfgaacAfc Cfaugaasgsg | 1442 | UUCAUGGUGUUC CAAGCCUUG | 1599 |
| 1189068 | cscsaag(Chd) CfuUfGfGfcuc aauacscsa | 1286 | VPusGfsguaUf uGfAfgccaAfg Gfcuuggsasa | 1443 | CCAAGCCUUGGC UCAAUACCA | 1600 |
| 1189069 | csasagc(Chd) UfuGfGfCfuca auaccsasa | 1287 | VPusUfsgguAf uUfGfagccAfa Gfgcuugsgsa | 1444 | CAAGCCUUGGCU CAAUACCAA | 1601 |
| 1189071 | asgsccu(Uhd) GfgCfUfCfaau accaasasa | 1288 | VPusUfsuugGf uAfUfugagCfc Afaggcusgsg | 1445 | AGCCUUGGCUCA AUACCAAAA | 1602 |
| 1189144 | cscsacc(Ghd) UfaUfCfCfacu gggaasusa | 1289 | VPusAfsuucCf cAfGfuggaUfa Cfggugsgsu | 1446 | CCACCGUAUCCA CUGGGAAUC | 1603 |
| 1189175 | csusgcg(Ahd) UfcAfGfAfaga gaccasasa | 1290 | VPusUfsuggUf cUfCfuucuGfa Ufcgcagsgsa | 1447 | CUGCGAUCAGAA GAGACCAAG | 1604 |
| 1189176 | usgscga(Uhd) CfaGfAfAfgag accaasgsa | 1291 | VPusCfsuugGf uCfUfcuucUfg Afucgcasgsg | 1448 | UGCGAUCAGAAG AGACCAAGG | 1605 |
| 1189189 | cscsaag(Ghd) AfaAfAfUfgag gguuuscsa | 1292 | VPusGfsaaaCf cCfUfcauuUfu Cfcuuggsusc | 1449 | CCAAGGAAAAUG AGGGUUUCA | 1606 |
| 1189191 | asasgga(Ahd) AfaUfGfAfggg uuucascsa | 1293 | VPusGfsugaAf aCfCfcucaUfu Ufuccuusgsg | 1450 | AAGGAAAAUGAG GGUUUCACA | 1607 |
| 1189284 | asascuc(Ahd) CfcUfGfUfaau aaauuscsa | 1294 | VPusGfsaauUf uAfUfuacaGfg Ufgaguusgsa | 1451 | AACUCACCUGUA AUAAAUUCG | 1608 |
| 1189285 | ascsuca(Chd) CfuGfUfAfaua aauucsgsa | 1295 | VPusCfsgaaUf uUfAfuuacAfg Gfugagusug | 1452 | ACUCACCUGUAA UAAAUUCGA | 1609 |
| 1189248 | csuscac(Chd) UfgUfAfAfuaa auucgsasa | 1296 | VPusUfscgaAf uUfUfauuaCfa Gfgugagsusu | 1453 | CUCACCUGUAAU AAAUUCGAC | 1610 |
| 1189288 | ascscug(Uhd) AfaUfAfAfauu cgaccsusa | 1297 | VPusAfsgguCf gAfAfuuuaUfu Afcaggusgsa | 1454 | ACCUGUAAUAAA UUCGACCUC | 1611 |
| 1189249 | cscsugu(Ahd) AfuAfAfAfuuc gaccuscsa | 1298 | VPusGfsaggUf cGfAfauuuAfu Ufacaggsusg | 1455 | CCUGUAAUAAAU UCGACCUCA | 1612 |
| 1189289 | csusgua(Ahd) UfaAfAfUfucg accucsasa | 1299 | VPusUfsgagGf uCfGfaauuUfa Ufuacagsgsu | 1456 | CUGUAAUAAAUU CGACCUCAA | 1613 |
| 1189292 | usasaua(Ahd) AfuUfCfGfacc ucaagsgsa | 1300 | VPusCfscuuGf aGfGfucgaAfu Ufuauuascsa | 1457 | UAAUAAAUUCGA CCUCAAGGU | 1614 |
| 1189302 | gsasccu(Chd) AfaGfGfUfcac cauaasasa | 1301 | VPusUfsuuaUf gGfUfgaccUfu Gfaggucsgsa | 1458 | GACCUCAAGGUC ACCAUAAAA | 1615 |
| 1189303 | ascscuc(Ahd) AfgGfUfCfacc auaaasasa | 1302 | VPusUfsuuuAf uGfGfugacCfu Ufgagguscsg | 1459 | ACCUCAAGGUCA CCAUAAAAC | 1616 |

TABLE 9-continued

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 1189304 | cscsuca(Ahd) GfgUfCfAfcca uaaaascsa | 1303 | VPusGfsuuuUf aUfGfgugaCfc Ufugaggsusc | 1460 | CCUCAAGGUCAC CAUAAAACC | 1617 |
| 1189305 | csuscaa(Ghd) GfuCfAfCfcau aaaacscsa | 1304 | VPusGfsguuUf uAfUfggugAfc Cfuugagsgsu | 1461 | CUCAAGGUCACC AUAAAACCA | 1618 |
| 1189306 | uscsaag(Ghd) UfcAfCfCfaua aaaccsasa | 1305 | VPusUfsgguUf uUfAfugguGfa Cfcuugasgsg | 1462 | UCAAGGUCACCA UAAAACCAG | 1619 |
| 1189351 | asgsgau(Ghd) CfcAfAfGfaac acuausgsa | 1306 | VPusCfsauaGf uGfUfucuuGfg Cfauccusgsa | 1463 | AGGAUGCCAAGA ACACUAUGA | 1620 |
| 1189353 | gsasugc(Chd) AfaGfAfAfcac uaugasusa | 1307 | VPusAfsucaUf aGfUfguucUfu Gfgcaucscsu | 1464 | GAUGCCAAGAAC ACUAUGAUC | 1621 |
| 1189387 | asgsgau(Ghd) CfcAfCfUfaug ucuausasa | 1308 | VPusUfsauaGf aCfAfuaguGfg Cfauccusgsg | 1465 | AGGAUGCCACUA UGUCUAUAU | 1622 |
| 1189480 | csasgau(Ahd) CfaUfCfUfcca aguausgsa | 1309 | VPusCfsauaCf uUfGfgagaUfg Ufaucugsusc | 1466 | CAGAUACAUCUC CAAGUAUGA | 1623 |
| 1189501 | usgsgac(Ahd) AfaGfCfCfuuc uccgasusa | 1310 | VPusAfsucgGf aGfAfaggcUfu Ufguccasgsc | 1467 | UGGACAAAGCCU UCUCCGAUA | 1624 |
| 1189522 | asgsgaa(Chd) AfcCfCfUfcau caucusasa | 1311 | VPusUfsagaUf gAfUfgaggGfu Gfuuccusasu | 1468 | AGGAACACCCUC AUCAUCUAC | 1625 |
| 1189503 | gsgsaac(Ahd) CfcCfUfCfauc aucuascsa | 1312 | VPusGfsuagAf uGfAfugagGfg Ufguuccsusa | 1469 | GGAACACCCUCA UCAUCUACC | 1626 |
| 1189524 | asascac(Chd) CfuCfAfUfcau cuaccsusa | 1313 | VPusAfsgguAf gAfUfgaugAfg Gfguguuscsc | 1470 | AACACCCUCAUC AUCUACCUG | 1627 |
| 1189576 | uscsuag(Chd) UfuUfCfAfaag uucacscsa | 1314 | VPusGfsgugAf aCfUfuugaAfa Gfcuagascsa | 1471 | UCUAGCUUUCAA AGUUCACCA | 1628 |
| 1189577 | csusagc(Uhd) UfuCfAfAfagu ucaccsasa | 1315 | VPusUfsgguGf aAfCfuuugAfa Afgcuagsasc | 1472 | CUAGCUUUCAAA GUUCACCAA | 1629 |
| 1189598 | csusuua(Ahd) UfgUfAfGfagc uuaucscsa | 1316 | VPusGfsgauAf aGfCfucuaCfa Ufuaaagsusa | 1473 | CUUUAAUGUAGA GCUUAUCCA | 1630 |
| 1189599 | ususuaa(Uhd) GfuAfGfAfgcu uauccsasa | 1317 | VPusUfsggaUf aAfGfcucuAfc Afuuaaasgsu | 1474 | UUUAAUGUAGAG CUUAUCCAG | 1631 |
| 1189628 | asgsuca(Ahd) GfgUfCfUfacg ccuaususa | 1318 | VPusAfsauaGf gCfGfuagaCfc Ufugacusgsc | 1475 | AGUCAAGGUCUA CGCCUAUUA | 1632 |
| 1189630 | uscsaag(Ghd) UfcUfAfCfgcc uauuascsa | 1319 | VPusGfsuaaUf aGfGfcguaGfa Cfcuugascsu | 1476 | UCAAGGUCUACG CCUAUUACA | 1633 |
| 1189631 | csasagg(Uhd) CfuAfCfGfccu auuacsasa | 1320 | VPusUfsguaAf uAfGfgcguAfg Afccuugsasc | 1477 | CAAGGUCUACGC CUAUUACAA | 1634 |

TABLE 9-continued

Modified Sense and Antisense Strand Sequences of Complement Component C3 dsRNA Agents

| Duplex | Sense sequence 5' to 3' | SEQ ID NO | Antisense sequence 5' to 3' | SEQ ID NO | Target sequence | SEQ ID NO |
|---|---|---|---|---|---|---|
| 1189632 | asasggu(Chd) UfaCfGfCfcua uuacasasa | 1321 | VPusUfsuguAf aUfAfggcgUfa Gfaccuusgsa | 1478 | AAGGUCUACGCC UAUUACAAC | 1635 |
| 1189633 | asgsguc(Uhd) AfcGfCfCfuau uacaascsa | 1322 | VPusGfsuugUf aAfUfaggcGfu Afgaccususg | 1479 | AGGUCUACGCCU AUUACAACC | 1636 |
| 1189635 | gsuscua(Chd) GfcCfUfAfuua caaccsusa | 1323 | VPusAfsgguUf gUfAfauagGfc Gfuagacscsu | 1480 | GUCUACGCCUAU UACAACCUG | 1637 |
| 1189636 | uscsuac(Ghd) CfcUfAfUfuac aaccusgsa | 1324 | VPusCfsaggUf uGfUfaauaGfg Cfguagascsc | 1481 | UCUACGCCUAUU ACAACCUGG | 1638 |
| 1189817 | gsgsagu(Ghd) GfaCfUfAfugu guacasasa | 1325 | VPusUfsuguAf cAfCfauagUfc Cfacuccsusg | 1482 | GGAGUGGACUAU GUGUACAAG | 1639 |
| 1189819 | asgsugg(Ahd) CfuAfUfGfugu acaagsasa | 1326 | VPusUfscuuGf uAfCfacauAfg Ufccacuscsc | 1483 | AGUGGACUAUGU GUACAAGAC | 1640 |
| 1189820 | gsusgga(Chd) UfaUfGfUfgua caagascsa | 1327 | VPusGfsucuUf gUfAfcacaUfa Gfuccacsusc | 1484 | GUGGACUAUGUG UACAAGACC | 1641 |
| 1189811 | usgsgac(Uhd) AfuGfUfGfuac aagacscsa | 1328 | VPusGfsgucUf uGfUfacacAfu Afguccascsu | 1485 | UGGACUAUGUGU ACAAGACCC | 1642 |
| 1189856 | asgscug(Uhd) CfcAfAfUfgac uuugascsa | 1329 | VPusGfsucaAf aGfUfcauuGfg Afcagcusgsa | 1486 | AGCUGUCCAAUG ACUUUGACG | 1643 |
| 1189857 | gscsugu(Chd) CfaAfUfGfacu uugacsgsa | 1330 | VPusCfsgucAf aAfGfucauUfg Gfacagcsusg | 1487 | GCUGUCCAAUGA CUUUGACGA | 1644 |
| 1190061 | gsasgaa(Chd) CfaGfAfAfaca augccsasa | 1331 | VPusUfsggcAf uUfGfuuucUfg Gfuucucsusu | 1488 | GAGAACCAGAAA CAAUGCCAG | 1645 |
| 1190101 | asgscau(Ghd) GfuUfGfUfcuu ugggusgsa | 1332 | VPusCfsaccCf aAfAfgacaAfc Cfaugcuscsu | 1489 | AGCAUGGUUGUC UUUGGGUGC | 1646 |

Example 3. In Vivo Screening of dsRNA Duplexes in Mice

Duplexes of interest identified from the above in vitro studies are evaluated in vivo.

One eye of each mouse is administered intraveally a single 2.5 μg or 7.5 μg dose of a dsRNA agent or a control at Day 0. At Day 7, ocular tissues are harvested and the vitreous fluid is removed. Tissue lysates are prepared using a protocol similar to the protocol described in Foster D. J., et al. (2018) *Mol. Ther.* 26:708. Ocular mRNA levels are assayed using a quantitative bDNA assay (Panomics). The mRNA level is calculated for each group and normalized to untreated tissue sample to give relative C3 mRNA as a % message remaining compared to the untreated tissue.

Example 4. In Vivo Evaluation in Transgenic Mice

This Example describes methods for the in vivo evaluation of C3 RNAi agents in transgenic mouse models of C3 associated CNS diseases, e.g., Alzheimer's disease (AD) multiple sclerosis (MS), neuromyelitis optica (NMO), neurotrauma, stroke, amyotrophic lateral sclerosis (ALS), Parkinson's disease (PD), and Huntington's disease (HD).

Some examples of available models of AD are the APP/PS1 and TauP301S models (see, e.g., Garcia-Alloza, M et al (2006) *Neurobiol Dis* 24(3): 516-24; Wu, T et al (2019) *Cell Rep* 28(8): 2111-2123; Rogers et al., (1992) *Proc Natl Acad Sci USA.* 89:10016-20' and Bradt et al. (1998) *J Exp Med.* 188:431-8.). Some examples of available models of MS are provided in Bettelli et al., 1998 (*J Exp Med.* 188:431-8) and Schraml et al., 2009 (*Nature* 460:405-9). Animal models for ALS include SOD1 G93A G37R mutations such as those provided in Gurney et al., 1994 (*Science* 264:1772-5) and Lobsinger et al., 2013 (*Proc Natl Acad Sci USA.* 110:E4385-92). Animal models for PD are provided, for example, in Fishbein et al., 2014 (*Brain* 137(Pt 12):3235-47); Kett et al., 2015 (*J Neurosci* 35:5724-42); and Ginns et al., 2014 (*Mol Genet Metab* 111:152-62. Models of HD are provided, for example, White et al., 1997 (*Nat Genet* 17:404-10) and Woodruff et al., 2006 (*FASEB J.* 20:1407-17). Many of the mouse models are commercially available from the Jackson Laboratory.

The ability of selected dsRNA agents designed and assayed in Example 1 are assessed for their ability to reduce the level of C3 expression in these animal models.

Briefly, littermates are intrathecally or subcutaneously administered a single dose of the dsRNA agents of interest, or a placebo. Two weeks after administration, animals are sacrificed, blood and tissue samples, including cerebral cortex, spinal cord, liver, spleen, and cervical lymph nodes, are collected.

To determine the effect of administration of the dsRNA agents targeting C3 on the level C3 mRNA, mRNA levels are determined in cortex and liver samples by qRT-PCR.

The effect of administration of the agents targeting C3 on the pathology of Alzheimer's disease in this mouse model is also assessed as described in Wu, T et al. (supra), using methods that are known to a person skilled in the art.

Briefly, littermates are intrathecally or subcutaneously administered two doses of the dsRNA agents of interest, or a placebo, at birth, 8 and 16 weeks of age. At 3, 6 and 9 months, longitudinal MRI imaging is performed to take images of mouse brains. The effect of the dsRNA agents on reducing brain atrophy is assessed. Volume of regions of interest (ventricles, neocortex, and hippocampus) are calculated and normalized to whole brain to minimize differences associated with size of the animals.

Example 5. Synthesis of Monomers to Introduce Lipophilic Ligands at Various Positions of siRNA's (Terminal and Internal) as Solid Support or Phosphoramidites A variety of lipids can be conjugated with hydroxyprolinol derivatives as shown below and the building block phosphoramidites can be incorporated into siRNAs.

General scheme 1

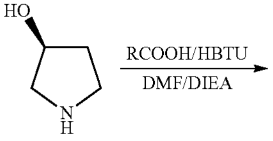

1

-continued

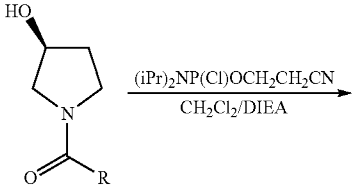

2

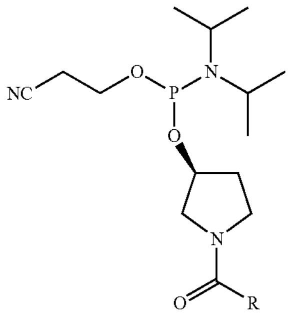

3

RCOOH:
(a) Decanoic acid (C10)
(b) Lauric acid (C12)
(c) Myristic acid (C14)
(d) Palmitic acid (C16)
(e) Stearic acid (C18)
(f) Docosanoic acid (C22)
(g) Oleic acid
(h) Linoleic acid
(i) Docosahexaenoic acid or

R =

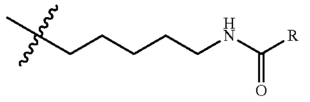

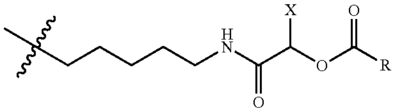

X = Me, Et, iPr, alkyl

General scheme 2

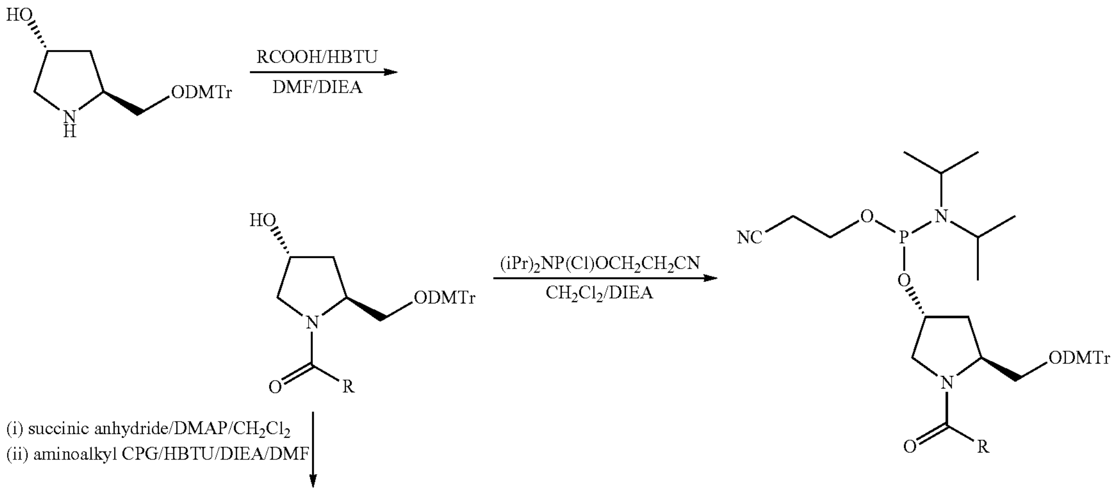

-continued
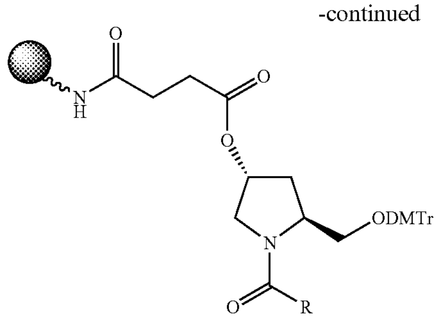
RCOOH:
(a) Decanoic acid (C10)
(b) Lauric acid (C12)
(c) Myristic acid (C14)
(d) Palmitic acid (C16)
(e) Stearic acid (C18)
(f) Docosanoic acid (C22)
(g) Oleic acid
(h) Linoleic acid
(i) Docosahexaenoic acid
or
R =
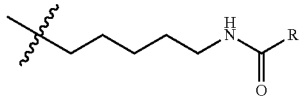
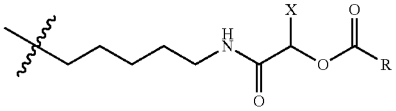
X = Me, Et, iPr, alkyl
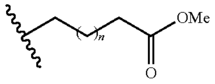
n = 12, 14, 16
General scheme 3
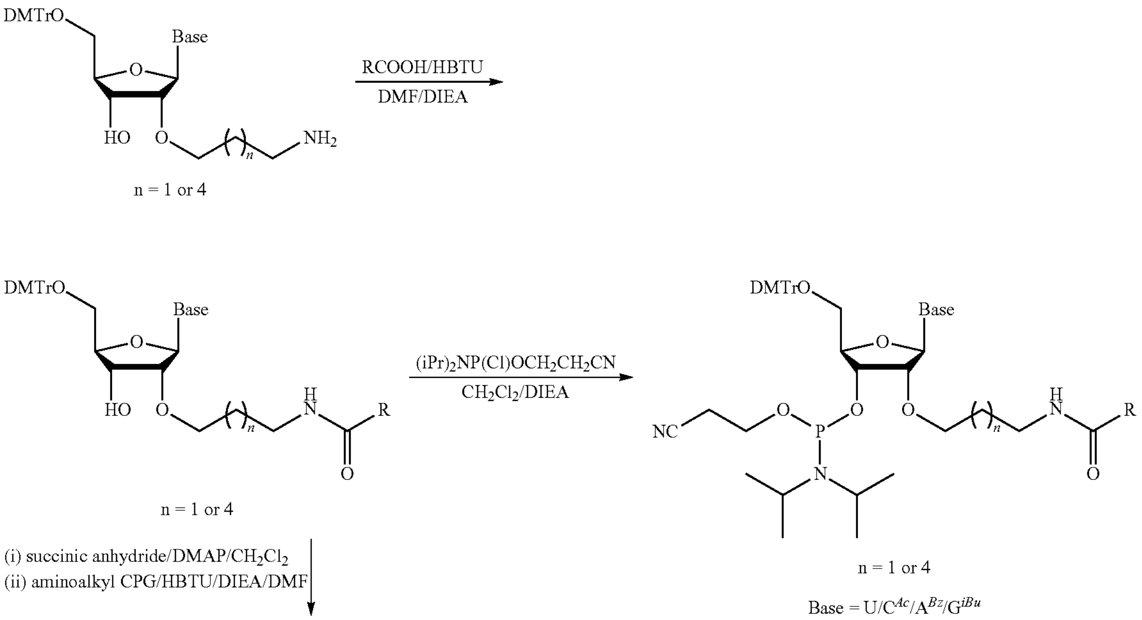

-continued
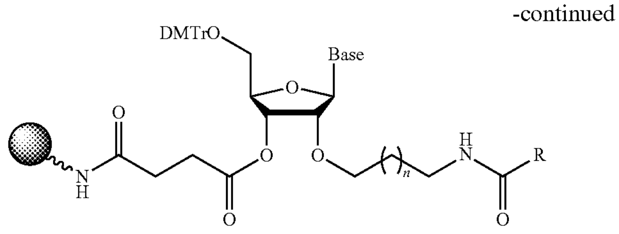
n = 1 or 4
RCOOH:
(a) Decanoic acid (C10)
(b) Lauric acid (C12)
(c) Myristic acid (C14)
(d) Palmitic acid (C16)
(e) Stearic acid (C18)
(f) Docosanoic acid (C22)
(g) Oleic acid
(h) Linoleic acid
(i) Docosahexaenoic acid
or
R =
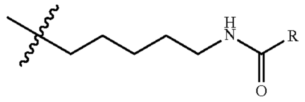
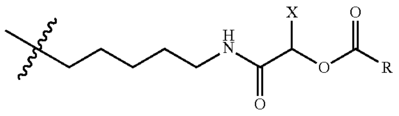
X = Me, Et, iPr, alkyl
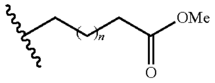
n = 12, 14, 16
Synthesis of Lipophilic Conjugate on Prolinol at 5' End Scheme 4
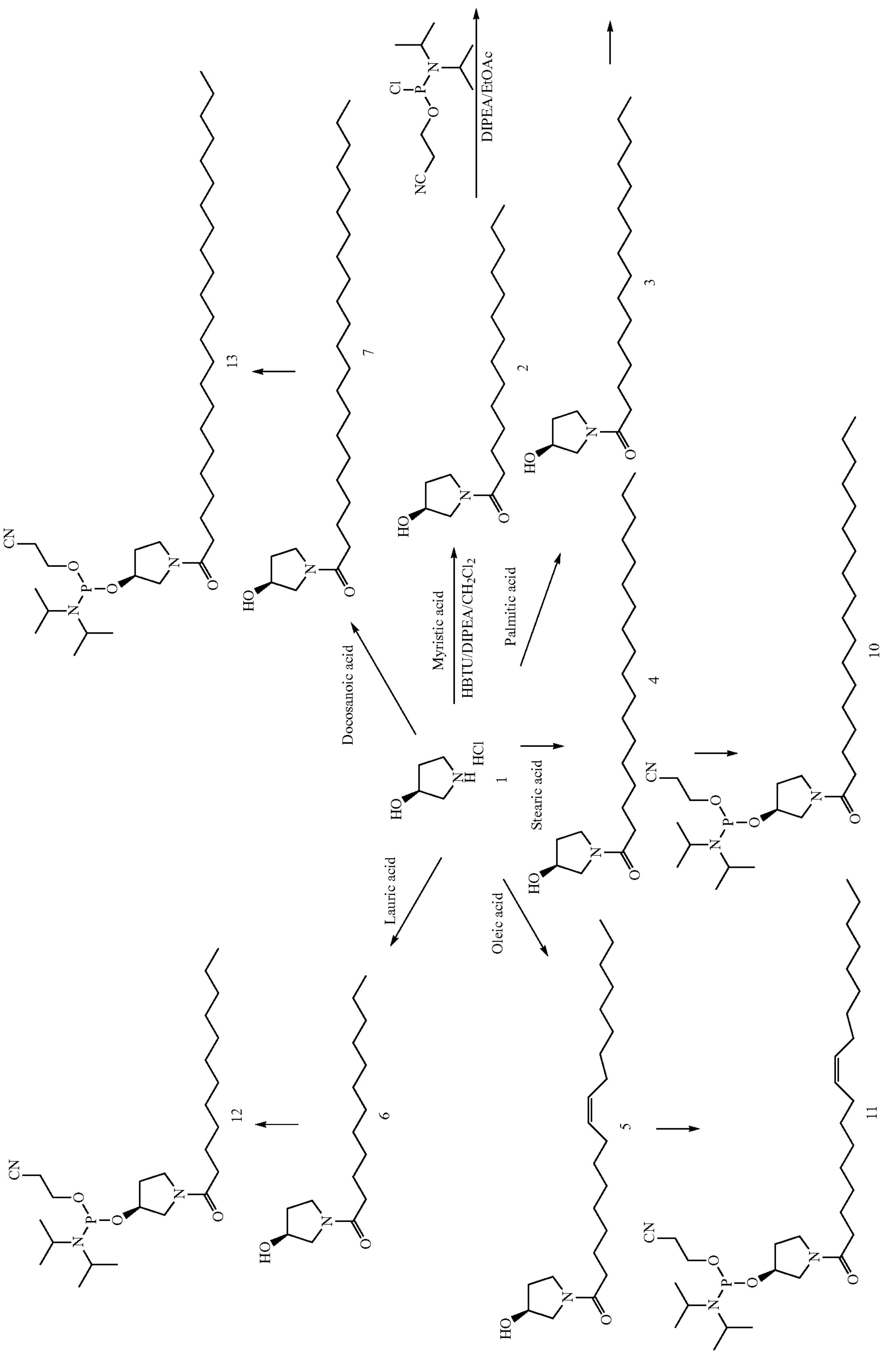

-continued
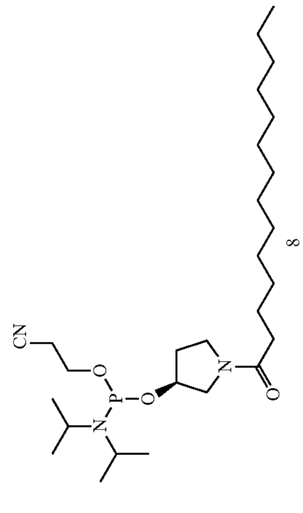
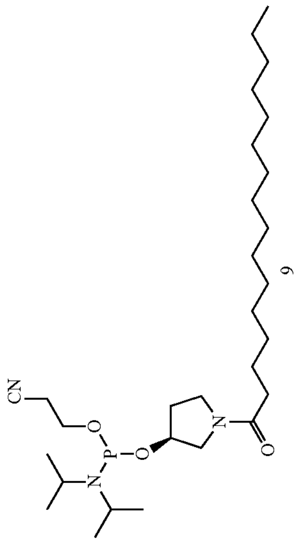

Compound 2: To a heat-oven dried 100 mL RBF, added a solution of compound 1, (3 g, 24.28 mmol, 1.0 equiv.) in anhydrous DCM (50 mL), tetradecanoic acid 2a (6.10 g, 26.70 mmol, 1.1 eq.) was added to the solution, followed by HBTU (10.13 g, 26.70 mmol, 1.1 eq) and DIPEA (12.68 mL, 72.53 mmol, 3 eq). The resultant solution was stirred at room temperature under argon overnight. TLC with 80% EtOAc/Hexane showed formation of product. The reaction mixture was quenched with brine solution, extracted with DCM. The combined organic solution was dried over anhydrous $Na_2SO_4$, filtered and concentrated to an oil form residue. Purification through ISCO column chromatography with 80 g silica gel column eluted compound 2 with 0-70% EtOAc/hexane. Yield a white oily compound (7.2 g). $^1$H NMR (400 MHz, Chloroform-d) δ 4.58-4.45 (m, 1H), 3.70-3.37 (m, 4H), 2.31-2.18 (m, 2H), 2.09-1.87 (m, 3H), 1.63 (t, J=7.4 Hz, 2H), 1.36-1.27 (m, 6H), 1.25 (s, 14H), 0.87 (t, J=6.8 Hz, 3H). M+1=298.3

Compound 3: Compound 3 was obtained by using compound 1 and palmitic acid in similar manner to compound 2. $^1$H NMR (500 MHz, Chloroform-d) δ 8.00 (s, 1H), 3.67-3.47 (m, 2H), 2.95 (s, 3H), 2.87 (s, 3H), 2.79 (s, 6H), 2.30-2.18 (m, 1H), 2.04 (h, J=3.5 Hz, 1H), 1.62 (p, J=7.2, 6.8 Hz, 2H), 1.32-1.26 (m, 4H), 1.24 (s, 11H), 0.87 (t, J=6.8 Hz, 2H). M+1=326.4

Compound 4: Compound 4 was obtained by using compound 1 and stearic acid in similar manner to compound 2. $^1$H NMR (400 MHz, Chloroform-d) δ 4.57-4.45 (m, 1H), 3.56 (dddd, J=31.4, 13.1, 10.0, 6.5 Hz, 4H), 2.80 (s, 3H), 2.31-2.18 (m, 3H), 2.04 (td, J=5.8, 2.9 Hz, 1H)), 1.28 (d, J=8.1 Hz, 28H), 0.87 (t, J=6.7 Hz, 3H). M+1=354.4

Compound 5: Compound 5 was obtained by using compound 1 and oleic acid in similar manner to compound 2. $^1$H NMR (400 MHz, Chloroform-d) δ 5.40-5.27 (m, 2H), 3.67-3.46 (m, 4H), 2.80 (s, 9H), 2.36-2.16 (m, 3H), 1.36-1.21 (m, 20H), 0.91-0.83 (m, 3H). M+1=352.3

Compound 6: Compound 6 was obtained by using compound 1 and dodecanoic acid in similar manner to compound 2. M+1=270.3

Compound 7: Compound 7 was obtained by using compound 1 and docosanoic acid in similar manner to compound 2. $^1$H NMR (400 MHz, Chloroform-d) δ 4.52 (d, J=18.9 Hz, 2H), 3.69-3.15 (m, 5H), 2.32-2.18 (m, 2H), 2.03 (ddp, J=13.4, 9.0, 4.4 Hz, 2H), 1.73-1.60 (m, 3H), 1.32 (t, J=9.6 Hz, 8H), 1.25 (s, 25H), 0.88 (t, J=6.6 Hz, 3H). M+1=410.4

Compound 8: Compound 2 (7.2 g, 24.2 mmol, 1 eq.) was dissolved in anhydrous EtOAc (120 mL). Cooled in an ice bath and under argon, added DIPEA (12.65 mL, 72.61 mmol, 3 eq.) followed by N,N-Diisopropylaminocyanoethyl phosphonamidic-Cl (6.30 g, 26.61 mmol, 1.1 eq.). After the addition, the reaction mixture was stirred at rt overnight. TLC at 50% EtOAc/Hexane showed completion of reaction. The reaction mixture was quenched with brine, extracted with EtOAc. The organic layer was separated, dried over $Na_2SO_4$ and concentrated to a white oil. ISCO purification eluted compound 8 with 0-50% EtOAc/hexane. Yield 65%, 7.71 g. $^1$H NMR (400 MHz, Acetonitrile-$d_3$) δ 4.54 (dddt, J=17.4, 10.1, 5.8, 2.8 Hz, 1H), 3.88-3.34 (m, 7H), 2.66 (q, J=5.7 Hz, 2H), 2.33-2.15 (m, 3H), 2.09 (ddt, J=11.9, 7.8, 3.9 Hz, 1H), 1.62-1.51 (m, 2H), 1.38-1.25 (m, 20H), 1.25-1.13 (m, 13H), 0.95-0.87 (m, 3H). $^{31}$P NMR (162 MHz, $CD_3CN$) δ 147.33, 147.15, 146.97, 146.88.

Compound 9: Compound 9 was obtained using compound 3 and N,N-Diisopropylamino-cyanoethyl phosphonamidic-Cl in a similar manner to compound 8. $^1$H NMR (400 MHz, Acetonitrile-$d_3$) δ 4.61-4.43 (m, 1H), 3.87-3.70 (m, 2H), 3.70-3.34 (m, 6H), 2.67 (t, J=5.8 Hz, 2H), 2.33-2.14 (m, 3H), 2.09 (ddt, J=12.1, 7.9, 3.9 Hz, 1H), 1.30 (s, 25H), 1.25-1.14 (m, 13H), 0.97-0.87 (m, 3H). $^{31}$P NMR (162 MHz, $CD_3CN$) 6147.33, 147.15, 146.97, 146.88.

Compound 10: Compound 10 was obtained using compound 4 and N, N-Diisopropylamino-cyanoethyl phosphonamidic-Cl in a similar manner to compound 8. $^1$H NMR (400 MHz, Acetonitrile-$d_3$) δ 4.66-4.40 (m, 1H), 3.87-3.34 (m, 8H), 2.67 (t, J=5.8 Hz, 2H), 2.30-2.16 (m, 3H), 2.15-2.02 (m, 1H), 1.30 (s, 27H), 1.29-1.16 (m, 15H), 0.95-0.87 (m, 3H). $^{31}$P NMR (162 MHz, $CD_3CN$) δ 147.32, 147.15, 146.97, 146.88.

Compound 11: Compound 11 was obtained using compound 5 and N, N-Diisopropylamino-cyanoethyl phosphonamidic-Cl in a similar manner to compound 8. $^1$H NMR (400 MHz, Acetonitrile-$d_3$) δ 5.43-5.33 (m, 2H), 4.54 (dddd, J=20.3, 9.7, 4.8, 2.1 Hz, 1H), 3.88-3.72 (m, 2H), 3.72-3.34 (m, 6H), 2.66 (q, J=5.7 Hz, 2H), 2.33-2.16 (m, 4H), 1.42-1.28 (m, 21H), 1.28-1.14 (m, 14H), 0.95-0.87 (m, 3H). $^{31}$P NMR (162 MHz, $CD_3CN$) δ 147.34, 147.17, 147.00, 146.90.

Compound 12: Compound 12 was obtained using compound 6 and N, N-Diisopropylamino-cyanoethyl phosphonamidic-Cl in a similar manner to compound 8. $^1$H NMR (400 MHz, Acetonitrile-$d_3$) δ 4.63-4.43 (m, 1H), 3.88-3.70 (m, 2H), 3.70-3.34 (m, 6H), 2.67 (t, J=5.8 Hz, 2H), 2.33-2.15 (m, 5H), 2.09 (ddt, J=12.3, 8.1, 3.9 Hz, 1H), 1.40-1.13 (m, 29H), 0.95-0.87 (m, 3H). $^{31}$P NMR (162 MHz, $CD_3CN$) δ 147.33, 147.15, 146.97, 146.86.

Compound 13: Compound 13 was obtained using compound 7 and N, N-Diisopropylamino-cyanoethyl phosphonamidic-Cl in a similar manner to compound 8. $^1$H NMR (400 MHz, Acetonitrile-$d_3$) δ 4.64-4.38 (m, 1H), 3.86-3.70 (m, 2H), 3.70-3.34 (m, 6H), 2.66 (q, J=5.7 Hz, 2H), 2.32-2.15 (m, 3H), 1.30 (s, 37H), 1.25-1.12 (m, 13H), 0.95-0.87 (m, 3H). $^{31}$P NMR (162 MHz, $CD_3CN$) δ 148.29, 147.33, 147.19, 147.01, 146.94.

Synthesis of Terminal Acid Containing Lipophilic Conjugate on Prolinol at 5' End Scheme 5
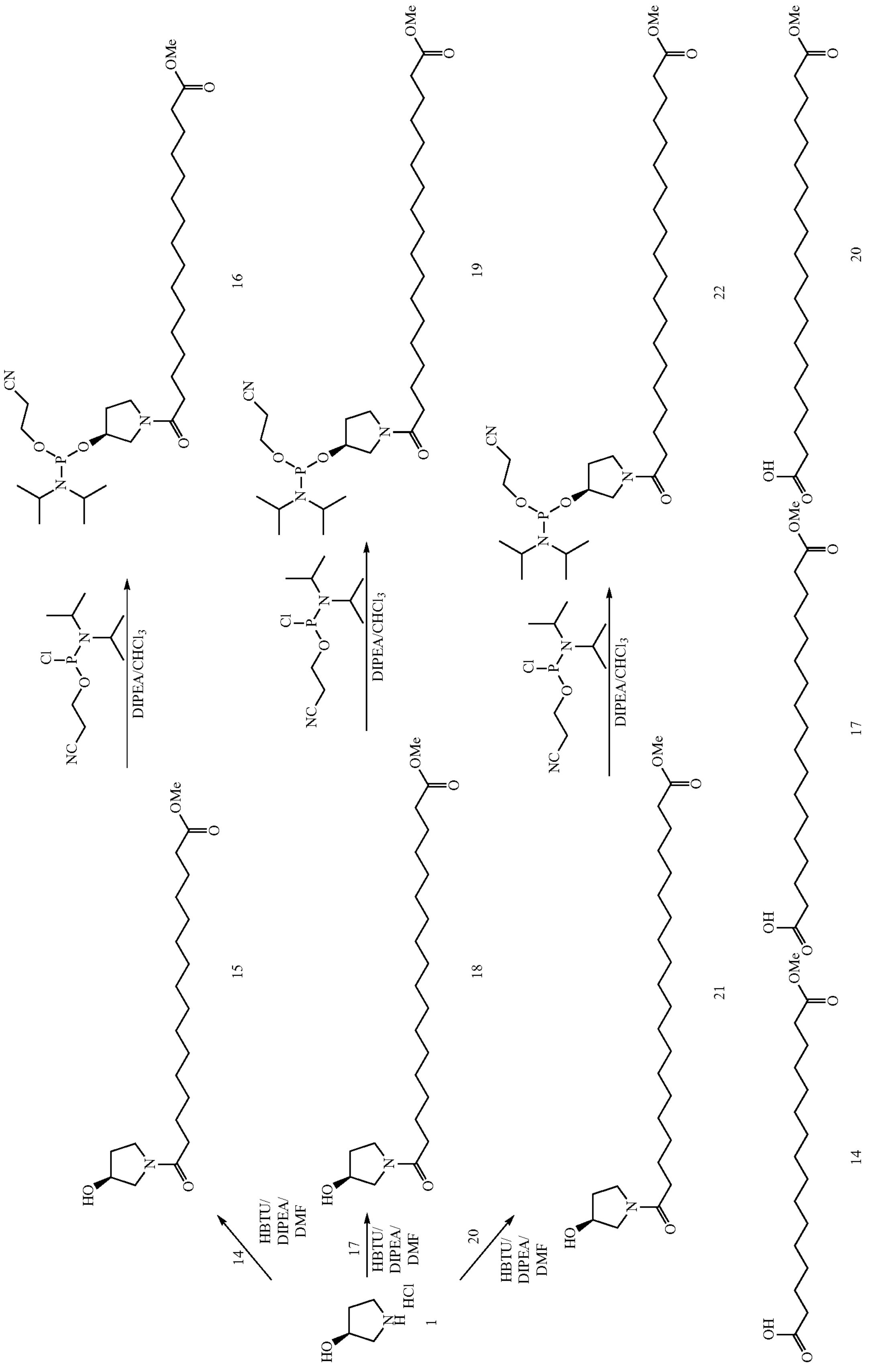
1, 14, 15, 16, 17, 18, 19, 20, 21, 22

Compound 15: A 3-L, three neck RBF equipped with a mechanical stirrer was charged with compound 14 (15 g, 49.9 mmol, 1 eq), HBTU (20.8 g, 54.9 mmol) and anh. DMF (350 mL). The mixture was stirred for 30 min to dissolve the starting material and then added DIPEA (17.3 mL, 99.8 mmol) drop wise while vigorously stirring at room temperature. The mixture was stirred at RT for 1.5 h then cooled to 0° C. A mixture of (S)-3-Pyrrolidinol 1 (6.78 g, 54.9 mmol), DIPEA (17.3 mL, 99.8 mmol) in DMF (110 mL) was added drop wise to the reaction mixture at 0° C. over 30 min then warmed to room temperature. The reaction mixture was stirred at room temperature for 12 h. Reaction progress was monitored by TLC (5% MeOH/Ethyle Acetate or 50% Ethylacetate/hexanes). The reaction was cooled to 0-5° C. and diluted with water (1.5 L), stirred for 30 min then filtered to collect brown solid compound 15, which was purified by column chromatography to afford compound 15 as light brown solid (17 g, 92%). $^1$H NMR (600 MHz, $CDCl_3$): δ 4.52 (d, 1H, J=30 Hz); 3.66 (s, 3H); 3.60-3.51 (m, 2H); 3.41 (d, 1H, 12 Hz); 2.34-2.20 (m, 4H); 2.07-2.01 (m, 4H); 1.68-1.56 (m, 4H); 1.36-1.20 (m, 20H).

Compound 16: An oven dried 500 mL single neck RBF was charged with compound 15 (8 g, 21.6 mmol, 1 eq) and chloroform (100 mL) under argon atm. Reaction mixture was cooled to 0° C. and then added DIPEA followed by drop wise addition of 2-cyanoethyl-N,N-diisopropyl-chlorophosphoramidite (5.31 mL, 23.8 mmol) at 0° C. The reaction mixture was slowly warmed to room temperature and stirred for 3 h. Reaction progress was monitored by TLC. The reaction mixture was cooled to 0° C. and quenched with MeOH (3 ml), stirred for 30 min then concentrated to afford crude product 16, which was purified by silica gel column chromatography. Pure fractions were combined, concentrated to afford compound 16 as thick syrup (4.38 g, 36%). $^1$H NMR (600 MHz, $CD_3CN$): δ 4.58-4.45 (m, 1H); 4.08-3.93 (m, 2H); 3.82-3.68 (m, 2H); 3.65 (s, 3H); 3.27-3.20 (m, 1H); 2.72-2.59 (m, 4H); 2.27 (t, J=6 Hz, 2H); 1.94-1.93 (m, 4H); 1.58-1.48 (m, 6H); 1.33-1.21 (m, 20H); 1.19-1.14 (m, 12H). $^{31}$P NMR (243 MHz, $CD_3CN$): 147.34, 147.16, 146.99, 146.89.

Compound 18: A 3-L, three neck RBF equipped with a mechanical stirrer was charged with compound 17 (14 g, 42.6 mmol, 1 eq), HBTU (17.8 g, 46.9 mmol) and anh. DMF (330 mL). The mixture was stirred for 30 min to dissolve solids then DIPEA (14.8 mL, 85.2 mmol) added drop wise while vigorously stirring at room temperature. The reaction mixture was stirred at RT for 1.5 h then cooled to 0° C. A mixture of (S)-3-Pyrrolidinol 1 (5.79 g, 46.9 mmol), DIPEA (14.8 mL, 85.2 mmol) in anh. DMF (125 mL) was added drop wise to the reaction mixture at 0° C. over 30 min. The mixture was warmed to room temperature and stirred for 18 h. The reaction progress was monitored by TLC (5% MeOH/Ethyle Acetate). The mixture was cooled to 0-5° C., quenched with water (1.5 L) slowly, stirred for 30 min and then filtered to collect brown solid compound 18. The crude product was purified by column chromatography to afford compound 18 as light brown solid (16.1 g, 95% yield). $^1$H NMR (600 MHz, $CDCl_3$): δ 4.53 (d, 1H, J=30 Hz); 3.66 (s, 3H); 3.60-3.49 (m, 2H); 3.41 (d, 1H, 12 Hz); 2.33-2.21 (m, 4H); 2.04-2.03 (m, 4H); 1.64-1.58 (m, 4H); 1.33-1.22 (m, 24H).

Compound 19: An oven dried 500 mL, single neck RBF was charged with compound 18 (13 g, 32.6 mmol, 1 eq) and chloroform (130 mL) under argon. The mixture was cooled to 0° C. and added catalytic amount of DMAP, DIPEA (17.1 mL, 98.0 mmol, 3 eq) followed by drop wise addition of 2-cyanoethyl-N,N-diisopropylchlorophosphoramidite (8.02 mL, 35.9 mmol) over a period of 15 min. The reaction mixture was warmed to room temperature and stirred for 5 h. The reaction progress was monitored by TLC (5% MeOH/Ethyl Acetate). The mixture was cooled to 0° C., quenched with MeOH (7 ml), stirred for 1 h then concentrated to afford crude product 19. The crude product was purified by silica gel column chromatography. Pure fractions were combined, concentrated and dried under high vacuum to afford compound 19 as thick syrup (10.17 g, 52% yield). $^1$H NMR (600 MHz, $CD_3CN$): δ 4.58-4.45 (m, 1H); 4.08-3.93 (m, 2H); 3.82-3.68 (m, 2H); 3.65 (s, 3H); 3.27-3.20 (m, 1H); 2.72-2.59 (m, 4H); 2.27 (t, J=6 Hz, 2H); 1.94-1.93 (m, 4H); 1.58-1.48 (m, 6H); 1.33-1.21 (m, 20H); 1.19-1.14 (m, 12H). $^{31}$P NMR (243 MHz, $CD_3CN$): 147.4, 147.3, 147.2, 147.0, 146.9.

Compound 21: A 3-L, three neck RBF equipped with a mechanical stirrer was charged with compound 20 (15 g, 35.2 mmol, 1 eq), HBTU (14.7 g, 38.7 mmol) and DMF (600 mL). The mixture was stirred for 30 min to dissolve solids and DIPEA (12.3 mL, 70.5 mmol) added drop wise while vigorously stirring at room temperature. The reaction mixture was stirred at RT for 1.5 h and then cooled to 0° C. A mixture of (S)-3-Pyrrolidinol 1 (4.79 g, 38.7 mmol), DIPEA (12.3 mL, 70.5 mmol) in anh. DMF (110 mL) was added drop wise to the reaction mixture at 0° C. over 30 min and then warmed to room temperature. The reaction mixture was stirred at room temperature for 15 h. The reaction progress was monitored by TLC (5% MeOH/Ethyle Acetate). The mixture was cooled to 0-5 0° C., quenched with water (1.5 L) slowly, stirred for 1.5 h and then filtered to collect brown solid compound 21, which was purified by column chromatography to afford compound 21 as light brown solid (16.1 g, 90%). $^1$H NMR (600 MHz, $CDCl_3$): δ 4.52 (d, 1H, J=30 Hz); 3.66 (s, 3H); 3.62-3.51 (m, 2H); 3.39 (d, 1H, 12 Hz); 2.31-2.19 (m, 4H); 2.06-2.02 (m, 4H); 1.62-1.55 (m, 4H); 1.31-1.26 (m, 28H).

Compound 22: An oven dried 500 mL single neck RBF was charged with compound 21 (16 g, 37.6 mmol, 1 eq) and chloroform (200 mL) under argon. The mixture was cooled to 0° C. and catalytic amount of DMAP, DIPEA (14.4 mL, 83.0 mmol, 3 eq) were added followed by drop wise addition of 2-cyanoethyl-N,N-diisopropylchlorophosphoramidite (6.78 mL, 30.4 mmol) over a period of 15 min. The reaction mixture was warmed to room temperature and stirred for 4 h. The reaction progress was monitored by TLC (5% MeOH/Ethyl Acetate). The mixture was cooled to 0° C., quenched with MeOH (7 ml), stirred for 30 min then concentrated to afford crude product 6, which was purified by silica gel column chromatography. Pure fractions were combined, concentrated and dried under high vacuum to afford compound 21 as thick syrup (9.7 g, 41%). $^1$H NMR (600 MHz, CDCN): δ 4.58-4.55 (m, 1H); 4.08-3.93 (m, 2H); 3.83-3.67 (m, 2H); 3.65 (m, 4H); 2.68-2.59 (m, 4H); 2.27 (t, J=6 Hz, 2H); 1.97-1.91 (m, 4H); 1.60-1.49 (m, 6H); 1.33-1.21 (m, 28H); 1.19-1.14 (m, 12H). $^{31}$P NMR (243 MHz, $CD_3CN$): 147.34, 147.16, 146.99, 146.90.

Synthesis of Lipophilic Conjugate on Prolinol at 3' End

Scheme 6
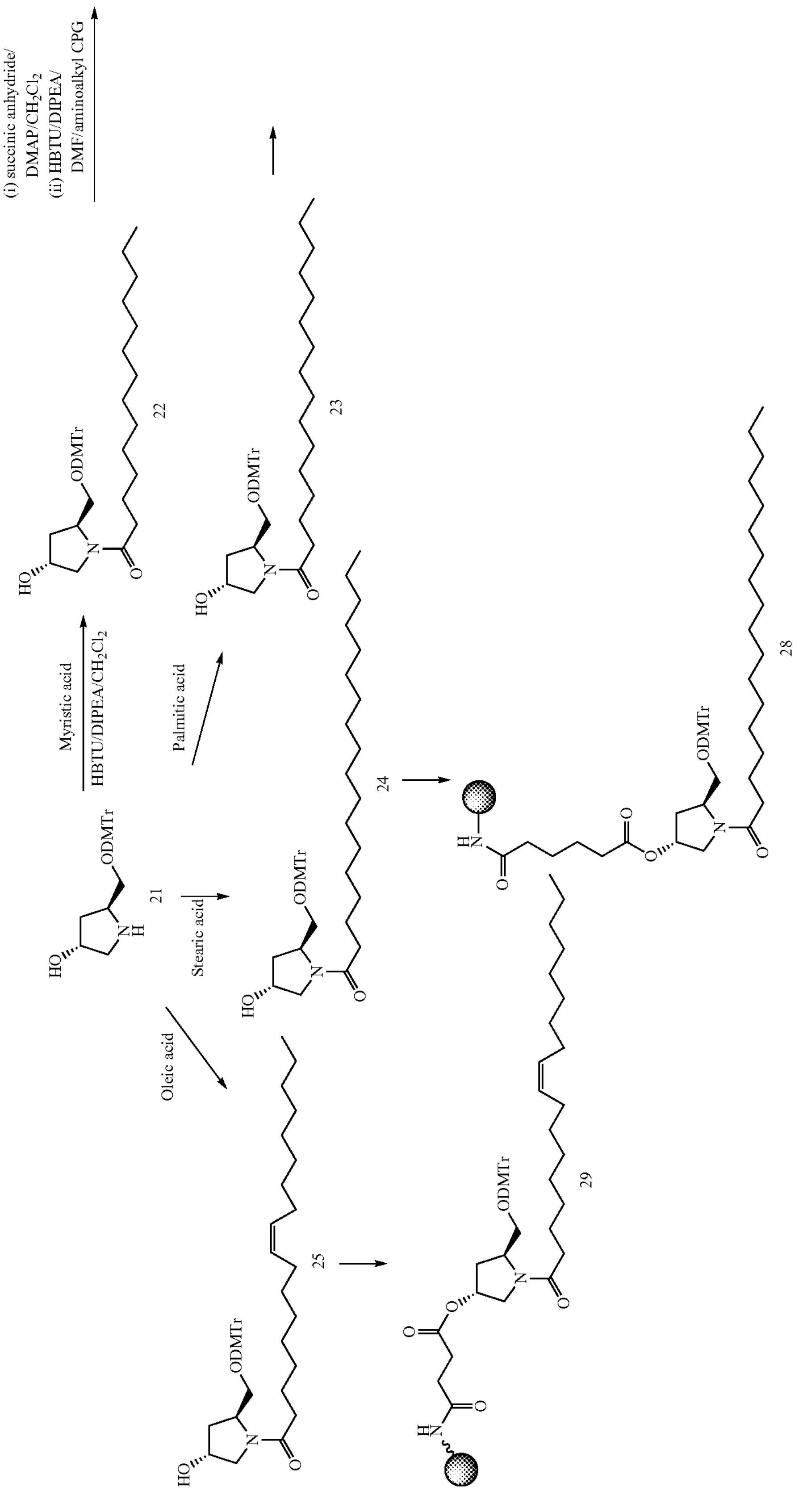
21 22 23 24 25 28 29

-continued
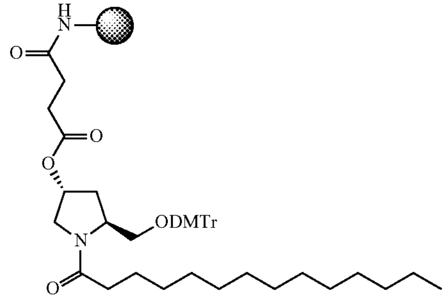
26
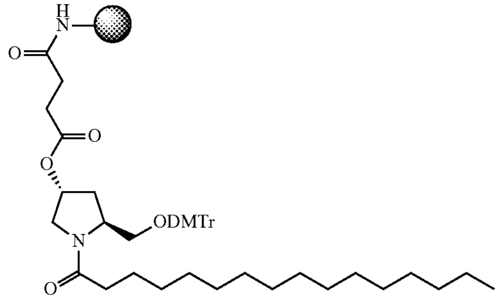
27
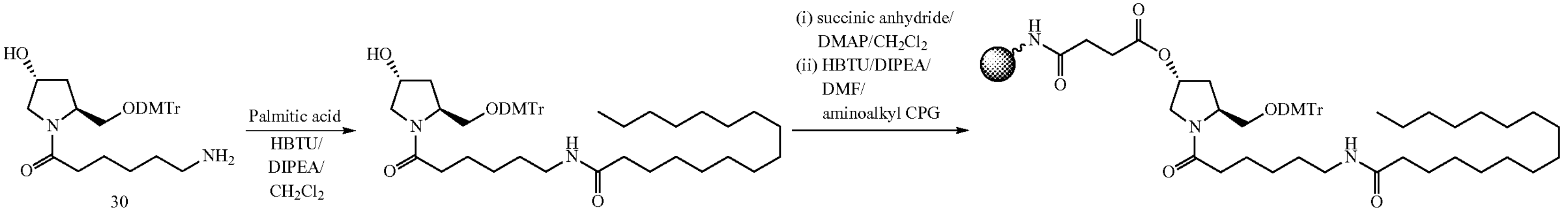
30
31
32

Compound 22: Compound 22 was synthesized using compound 21 and myristic acid under standard peptide coupling conditions in $CH_2Cl_2$. $^1H$ NMR (400 MHz, DMSO) δ 7.35-7.26 (m, 6H), 7.25-7.15 (m, 7H), 6.90-6.83 (m, 6H), 4.97 (d, J=4.0 Hz, 1H), 4.39 (dd, J=8.8, 4.3 Hz, 1H), 4.28 (dd, J=9.6, 4.4 Hz, 1H), 4.18-4.08 (m, 1H), 3.73 (s, 9H), 3.57 (dt, J=10.2, 5.1 Hz, 1H), 3.35-3.30 (m, 4H), 3.28-3.20 (m, 1H), 3.17 (dd, J=8.8, 5.0 Hz, 1H), 3.01-2.94 (m, 2H), 2.69 (s, 9H), 2.25-2.16 (m, 2H), 2.10-2.05 (m, 2H), 1.83 (ddd, J=12.8, 8.4, 4.7 Hz, 1H), 1.51-1.40 (m, 2H), 1.20 (d, J=18.9 Hz, 30H), 0.90-0.81 (m, 5H).

Compound 23: Compound 23 was synthesized using compound 21 and palmitic acid under standard peptide coupling conditions in $CH_2Cl_2$. $^1H$ NMR (400 MHz, DMSO) δ 7.36-7.24 (m, 7H), 7.24-7.15 (m, 8H), 6.91-6.81 (m, 7H), 4.97 (s, 1H), 4.39 (t, J=4.8 Hz, 1H), 4.20-4.07 (m, 2H), 3.71 (d, J=12.4 Hz, 10H), 3.57 (dt, J=10.5, 5.3 Hz, 1H), 3.38-3.28 (m, 4H), 3.18 (dd, J=8.8, 5.0 Hz, 1H), 3.02-2.94 (m, 2H), 2.71-2.64 (m, 14H), 2.20 (t, J=7.4 Hz, 2H), 2.02-1.96 (m, 4H), 1.46 (q, J=7.1 Hz, 2H), 1.30-1.20 (m, 33H), 0.84 (t, J=6.6 Hz, 5H).

Compound 24: Compound 24 was synthesized using compound 21 and stearic acid under standard peptide coupling conditions in $CH_2Cl_2$. $^1H$ NMR (400 MHz, DMSO) δ 7.35-7.25 (m, 6H), 7.23-7.15 (m, 8H), 6.90-6.83 (m, 6H), 4.97 (d, J=4.0 Hz, 1H), 4.42-4.36 (m, 1H), 4.18-4.11 (m, 1H), 3.72 (s, 9H), 3.57 (dt, J=10.1, 5.1 Hz, 1H), 3.45 (dd, J=12.1, 3.9 Hz, 1H), 3.24 (dd, J=12.1, 5.6 Hz, 1H), 3.18 (dd, J=8.8, 5.0 Hz, 1H), 3.02-2.95 (m, 2H), 2.69 (s, 14H), 2.20 (t, J=7.4 Hz, 2H), 2.04-1.96 (m, 2H), 1.52-1.43 (m, 2H), 1.30-1.14 (m, 40H), 0.84 (t, J=6.7 Hz, 4H).

Compound 25: Compound 25 was synthesized using compound 21 and oleic acid under standard peptide coupling conditions in $CH_2Cl_2$. $^1H$ NMR (400 MHz, DMSO) δ 7.36-7.24 (m, 6H), 7.24-7.15 (m, 7H), 6.90-6.83 (m, 6H), 5.35-5.26 (m, 3H), 4.97 (d, J=3.9 Hz, 1H), 4.39 (d, J=5.3 Hz, 1H), 4.20-4.07 (m, 2H), 3.71 (d, J=12.7 Hz, 9H), 3.57 (dt, J=8.8, 4.4 Hz, 1H), 3.17 (dd, J=8.9, 5.1 Hz, 1H), 3.02-2.94 (m, 2H), 2.67 (d, J=13.5 Hz, 13H), 2.22-2.16 (m, 2H), 2.02-1.92 (m, 7H), 1.47 (t, J=7.1 Hz, 2H), 1.25 (t, J=11.6 Hz, 26H), 0.83 (td, J=6.4, 2.1 Hz, 4H).

Compound 26: To a solution of compound 22 (5.67 g, 9.00 mmol) in anh. dichloromethane (86.26 mL), DMAP (1.10 g, 9.00 mmol) and succinic anhydride (1.80 g, 18.00 mmol) were added. The mixture was cooled to 0° C., and triethylamine (3.76 mL, 27.01 mmol) was added dropwise. The reaction mixture was stirred at rt for 18 h, after which showed no presence of starting material (5% Et3N in 5% MeOH in DCM). The mixture was concentrated under reduced pressure. The residue was purified by flash chromatography on silica gel (pre-treated with $Et_3N$) with gradient 0-5% MeOH in DCM to afford 4.91 g (75%) of the succinate. To a solution of the succinate (4.91 g, 6.73 mmol) in anh. DMF (331.64 mL), DIPEA (4.69 mL, 26.91 mmol) was added then stirred until fully dissolved. HBTU (2.68 g, 7.06 mmol) was added to the mixture and stirred for 5 min. Controlled pore glass (CPG) (152 μmol/g, 48.68 g, 7.40 mmol) was added to the mixture. The RBF was capped with a rubber septum and securely parafilmed, then shaken on a mechanical shaker overnight. The mixture was filtered through a glass fritted funnel under vacuum and rinsed in parallel with acetonitrile, methanol, acetonitrile, then diethyl ether (300 mL each). The filtrate was discarded, and the filtered material was vacuum dried on frit for 20 min. The filtered material was returned to the original flask and dried on high vac overnight. The loading of material on solid support was checked by UV-Vis and beer's law on a Beckman Coulter spectrophotometer. The solid support material was weighed out (53.5 mg), dissolved in 0.1 M p-Toluenesulfonic acid in acetonitrile in a 250 mL volumetric flask. The mixture was sonicated then allowed to sit undisturbed for 1 h. The machine was blanked with the same solvent then the UV absorbance at 411 nm of the solution was measured in triplicate. The rest of the solid support materials was capped using 30% acetic anhydride in pyridine with 1% $Et_3N$ (325 mL). The flask was capped and parafilmed then shaken on mechanical shaker for 3 h. the mixture was filtered on glass frit funnel under vacuum then washed in order: 10% $H_2O$ in THF, MeOH, 10% $H_2O$ in THF, MeOH, ACN, then diethyl ether (300 mL each). The filtrates were discarded, and the solid support material was dried on frit under vacuum. The solid support material was transferred to a RBF then dried on high vac overnight, to afford compound 4a (48.96 g, 106.92 μmol/g loading).

Compound 27: To a solution of compound 23 (5.10 g, 7.75 mmol) in anh. dichloromethane (74.28 mL), DMAP (947 mg, 7.75 mmol) and succinic anhydride (1.55 g, 15.50 mmol) were added. The mixture was cooled to 0° C., and triethylamine (3.24 mL, 23.26 mmol) was added dropwise. The reaction mixture was stirred at rt for 18 h, after which showed no presence of starting material (5% Et3N in 5% MeOH in DCM). The mixture was concentrated under reduced pressure. The residue was purified by flash chromatography on silica gel (pre-treated with $Et_3N$) with gradient 0-5% MeOH in DCM to afford 3.85 g (65%) of the succinate. $^1H$ NMR (400 MHz, DMSO-$d_6$) δ 7.36-7.24 (m, 6H), 7.20 (ddd, J=8.9, 6.0, 3.1 Hz, 7H), 6.87 (ddd, J=8.9, 5.2, 2.4 Hz, 6H), 5.36 (t, J=4.4 Hz, 1H), 4.20 (dq, J=9.2, 4.7, 4.2 Hz, 1H), 3.73 (s, 10H), 3.55 (dd, J=11.4, 3.0 Hz, 1H), 3.24 (dd, J=9.0, 4.6 Hz, 1H), 3.03 (ddd, J=20.0, 9.9, 3.9 Hz, 2H), 2.66 (q, J=7.2 Hz, 2H), 2.49-2.41 (m, 5H), 2.19 (ddp, J=22.3, 9.0, 5.1, 4.6 Hz, 4H), 2.06-1.91 (m, 1H), 1.50-1.41 (m, 2H), 1.30-1.14 (m, 32H), 1.01 (t, J=7.2 Hz, 2H), 0.84 (t, J=6.8 Hz, 4H). To a solution of the succinate (3.85 g, 5.08 mmol) in anh. DMF (250.42 mL), DIPEA (3.54 mL, 20.32 mmol) was added then stirred until fully dissolved. HBTU (2.02 g, 5.33 mmol) was added to the mixture and stirred for 5 min. Controlled pore glass (CPG) (152 μmol/g, 36.77 g, 5.59 mmol) was added to the mixture. The RBF was capped with a rubber septum and securely parafilmed, then shaken on a mechanical shaker overnight. The mixture was filtered through a glass fritted funnel under vacuum and rinsed in parallel with acetonitrile, methanol, acetonitrile, then diethyl ether (300 mL each). The filtrate was discarded, and the filtered material was vacuum dried on frit for 20 min. The filtered material was returned to the original flask and dried on high vac overnight. The loading of material on solid support was checked by UV-Vis and beer's law on a Beckman Coulter spectrophotometer. The solid support material was weighed out (59.7 mg), dissolved in 0.1 M p-Toluenesulfonic acid in acetonitrile in a 250 mL volumetric flask. The mixture was sonicated then allowed to sit undisturbed for 1 h. The machine was blanked with the same solvent then the UV absorbance at 411 nm of the solution was measured in triplicate. The rest of the solid support materials was capped using 30% acetic anhydride in pyridine with 1% $Et_3N$ (325 mL). The flask was capped and parafilmed then shaken on mechanical shaker for 3 h. the mixture was filtered on glass frit funnel under vacuum then washed in order: 10% $H_2O$ in THF, MeOH, 10% $H_2O$ in THF, MeOH, ACN, then diethyl ether (300 mL each). The filtrates were discarded, and the solid support material was dried on frit under vacuum. The solid support material was transferred to a RBF then dried on high vac overnight, to afford compound 27 (38.53 g, 112.87 μmol/g loading).

Compound 28: To a solution of compound 24 (5.53 g, 8.06 mmol) in anh. dichloromethane (77.24 mL), DMAP (984 mg, 8.06 mmol) and succinic anhydride (1.61 g, 16.12 mmol) were added. The mixture was cooled to 0° C., and triethylamine (3.37 mL, 24.18 mmol) was added dropwise. The reaction mixture was stirred at rt for 18 h, after which showed no presence of starting material (5% Et3N in 5% MeOH in DCM). The mixture concentrated under reduced pressure. The residue was purified by flash chromatography on silica gel (pre-treated with $Et_3N$) with gradient 0-5% MeOH in DCM to afford 5.18 g (81%) of the succinate. $^1H$ NMR (400 MHz, DMSO-$d_6$) δ 8.13-8.08 (m, 1H), 7.37-7.24 (m, 6H), 7.20 (ddd, J=9.1, 6.2, 3.3 Hz, 7H), 6.87 (ddd, J=8.7, 5.1, 2.4 Hz, 6H), 6.63-6.57 (m, 1H), 5.39-5.32 (m, 1H), 4.24-4.15 (m, 2H), 3.73 (s, 10H), 3.55 (dd, J=11.6, 3.0 Hz, 1H), 3.23 (dd, J=9.0, 4.6 Hz, 1H), 3.09-2.97 (m, 2H), 2.96 (s, 4H), 2.78 (q, J=7.2 Hz, 1H), 2.49-2.43 (m, 6H), 2.26-2.11 (m, 4H), 2.09-1.91 (m, 1H), 1.45 (q, J=7.1 Hz, 2H), 1.22 (d, J=4.9 Hz, 36H), 1.06 (t, J=7.2 Hz, 1H), 0.84 (t, J=6.8 Hz, 4H). To a solution of the succinate (5.18 g, 6.59 mmol) in anh. DMF (324.91 mL), DIPEA (4.59 mL, 26.36 mmol) was added then stirred until fully dissolved. HBTU (2.62 g, 6.92 mmol) was added to the mixture and stirred for 5 min. Controlled pore glass (CPG) (152 μmol/g, 47.69 g, 7.25 mmol) was added to the mixture. The RBF was capped with a rubber septum and securely parafilmed, then shaken on a mechanical shaker overnight. The mixture was filtered through a glass fritted funnel under vacuum and rinsed in parallel with acetonitrile, methanol, acetonitrile, then diethyl ether (300 mL each). The filtrate was discarded, and the filtered material was vacuum dried on frit for 20 min. The filtered material was returned to the original flask and dried on high vac overnight. The loading of material on solid support was checked by UV-Vis and beer's law on a Beckman Coulter spectrophotometer. The solid support material was weighed out (54.0 mg), dissolved in 0.1 M p-Toluenesulfonic acid in acetonitrile in a 250 mL volumetric flask. The mixture was sonicated then allowed to sit undisturbed for 1 h. The machine was blanked with the same solvent then the UV absorbance at 411 nm of the solution was measured in triplicate. The rest of the solid support materials was capped using 30% acetic anhydride in pyridine with 1% $Et_3N$ (325 mL). The flask was capped and parafilmed then shaken on mechanical shaker for 3 h. the mixture was filtered on glass frit funnel under vacuum then washed in order: 10% $H_2O$ in THF, MeOH, 10% $H_2O$ in THF, MeOH, ACN, then diethyl ether (300 mL each). The filtrates were discarded, and the solid support material was dried on frit under vacuum. The solid support material was transferred to a RBF then dried on high vac overnight, to afford compound 28 (50.60 g, 108.88 μmol/g loading).

Compound 29: To a solution of compound 25 (5.19 g, 7.59 mmol) in anh. dichloromethane (72.71 mL), DMAP (927 mg, 7.59 mmol) and succinic anhydride (1.52 g, 15.18 mmol) were added. The mixture was cooled to 0° C., and triethylamine (3.37 mL, 24.18 mmol) was added dropwise. The reaction mixture was stirred at rt for 18 h, after which showed no presence of starting material (5% Et3N in 5% MeOH in DCM). The mixture was concentrated under reduced pressure. The residue was purified by flash chromatography on silica gel (pre-treated with $Et_3N$) with gradient 0-5% MeOH in DCM to afford 5.47 g (92%) of compound 3d (R=$C_{18}H_{33}$). $^1H$ NMR (400 MHz, DMSO-$d_6$) δ 7.37-7.25 (m, 4H), 7.25-7.15 (m, 5H), 6.91-6.81 (m, 4H), 5.39-5.21 (m, 3H), 4.24-4.14 (m, 1H), 3.73 (s, 6H), 3.23 (dd, J=9.1, 4.6 Hz, 1H), 3.07-2.97 (m, 1H), 2.58 (q, J=7.2 Hz, 1H), 2.49-2.41 (m, 4H), 2.26-2.13 (m, 2H), 1.97 (q, J=6.9, 6.4 Hz, 4H), 1.45 (q, J=6.9 Hz, 1H), 1.24 (d, J=9.3 Hz, 19H), 0.99 (t, J=7.2 Hz, 2H), 0.83 (td, J=6.9, 1.9 Hz, 3H). To a solution of the succinate (5.47 g, 6.98 mmol) in anh. DMF (343.98 mL), DIPEA (4.86 mL, 27.91 mmol) was added then stirred until fully dissolved. HBTU (2.78 g, 7.33 mmol) was added to the mixture and stirred for 5 min. Controlled pore glass (CPG) (152 μmol/g, 50.46 g, 7.67 mmol) was added to the mixture. The RBF was capped with a rubber septum and securely parafilmed, then shaken on a mechanical shaker overnight. The mixture was filtered through a glass fritted funnel under vacuum and rinsed in parallel with acetonitrile, methanol, acetonitrile, then diethyl ether (300 mL each). The filtrate was discarded, and the filtered material was vacuum dried on frit for 20 min. The filtered material was returned to the original flask and dried on high vac overnight. The loading of material on solid support was checked by UV-Vis and beer's law on a Beckman Coulter spectrophotometer. The solid support material was weighed out (52.7 mg), dissolved in 0.1 M p-Toluenesulfonic acid in acetonitrile in a 250 mL volumetric flask. The mixture was sonicated then allowed to sit undisturbed for 1 h. The machine was blanked with the same solvent then the UV absorbance at 411 nm of the solution was measured in triplicate. The rest of the solid support materials was capped using 30% acetic anhydride in pyridine with 1% $Et_3N$ (325 mL). The flask was capped and parafilmed then shaken on mechanical shaker for 3 h. the mixture was filtered on glass frit funnel under vacuum then washed in order: 10% $H_2O$ in THF, MeOH, 10% $H_2O$ in THF, MeOH, ACN, then diethyl ether (300 mL each). The filtrates were discarded, and the solid support material was dried on frit under vacuum. The solid support material was transferred to a RBF then dried on high vac overnight, to afford compound 29 (51.63 g, 106.29 μmol/g loading).

Compound 31: Compound 31 was synthesized using compound 30 and palmitic acid under standard peptide coupling conditions in $CH_2Cl_2$.

Compound 32: To a solution of compound 31 (4.90 g, 6.35 mmol) in anh. dichloromethane (60.89 mL), DMAP (776 mg, 6.35 mmol) and succinic anhydride (1.27 g, 12.71 mmol) were added. The mixture was cooled to 0° C., and triethylamine (2.66 mL, 19.06 mmol) was added dropwise. The reaction mixture was stirred at rt for 18 h, after which showed no presence of starting material (5% Et3N in 5% MeOH in DCM). The mixture was concentrated under reduced pressure. The residue was purified by flash chromatography on silica gel (pre-treated with $Et_3N$) with gradient 0-10% MeOH in DCM to afford 4.34 g (78%) of the succinate. $^1H$ NMR (400 MHz, DMSO-$d_6$) δ 7.68 (q, J=5.5 Hz, 2H), 7.35-7.25 (m, 6H), 7.19 (ddt, J=8.9, 6.2, 2.9 Hz, 8H), 6.90-6.81 (m, 6H), 5.38-5.31 (m, 1H), 4.18 (d, J=4.5 Hz, 1H), 3.72 (s, 9H), 3.53 (dd, J=11.3, 3.2 Hz, 1H), 3.21 (dd, J=9.0, 4.7 Hz, 1H), 3.04-2.90 (m, 12H), 2.48-2.42 (m, 5H), 2.28-2.08 (m, 4H), 2.08-1.97 (m, 4H), 1.40 (dq, J=31.8, 7.0 Hz, 7H), 1.32-1.16 (m, 42H), 1.14 (t, J=7.2 Hz, 9H), 0.83 (t, J=6.6 Hz, 4H). To a solution of the succinate (4.34 g, 4.98 mmol) in anh. DMF (245.63 mL), DIPEA (3.74 mL, 19.93 mmol) was added then stirred until fully dissolved. HBTU (1.98 g, 5.23 mmol) was added to the mixture and stirred for 5 min. Controlled pore glass (CPG) (152 μmol/g, 36.05 g, 5.48 mmol) was added to the mixture. The RBF was capped with a rubber septum and securely parafilmed, then shaken on a mechanical shaker overnight. The mixture was filtered through a glass fritted funnel under vacuum and rinsed in parallel with acetonitrile, methanol, acetonitrile, then diethyl ether (300 mL each). The filtrate was discarded, and the filtered material was vacuum dried on frit for 20 min. The filtered material was returned to the original flask and dried on high vac overnight. The loading of material on solid support was checked by UV-Vis and beer's law on a Beckman Coulter spectrophotometer. The solid support material was weighed out (52.6 mg), dissolved in 0.1 M p-Toluenesulfonic acid in acetonitrile in a 250 mL volumetric flask. The mixture was sonicated then allowed to sit undisturbed for 1 h. The machine was blanked with the same solvent then the UV absorbance at 411 nm of the solution was measured in triplicate. The rest of the solid support materials was capped using 30% acetic anhydride in pyridine with 1% $Et_3N$ (325 mL). The flask was capped and parafilmed then shaken on mechanical shaker for 3 h. the mixture was filtered on glass frit funnel under vacuum then washed in order: 10% $H_2O$ in THF, MeOH, 10% $H_2O$ in THF, MeOH, ACN, then diethyl ether (300 mL each). The filtrates were discarded, and the solid support material was dried on frit under vacuum. The solid support material was transferred to a RBF then dried on high vac overnight, to afford compound 32 (37.59 g, 80.09 μmol/g loading).

Synthesis of Terminal Acid Containing Lipophilic Conjugate on Prolinol at 3' End Scheme 7
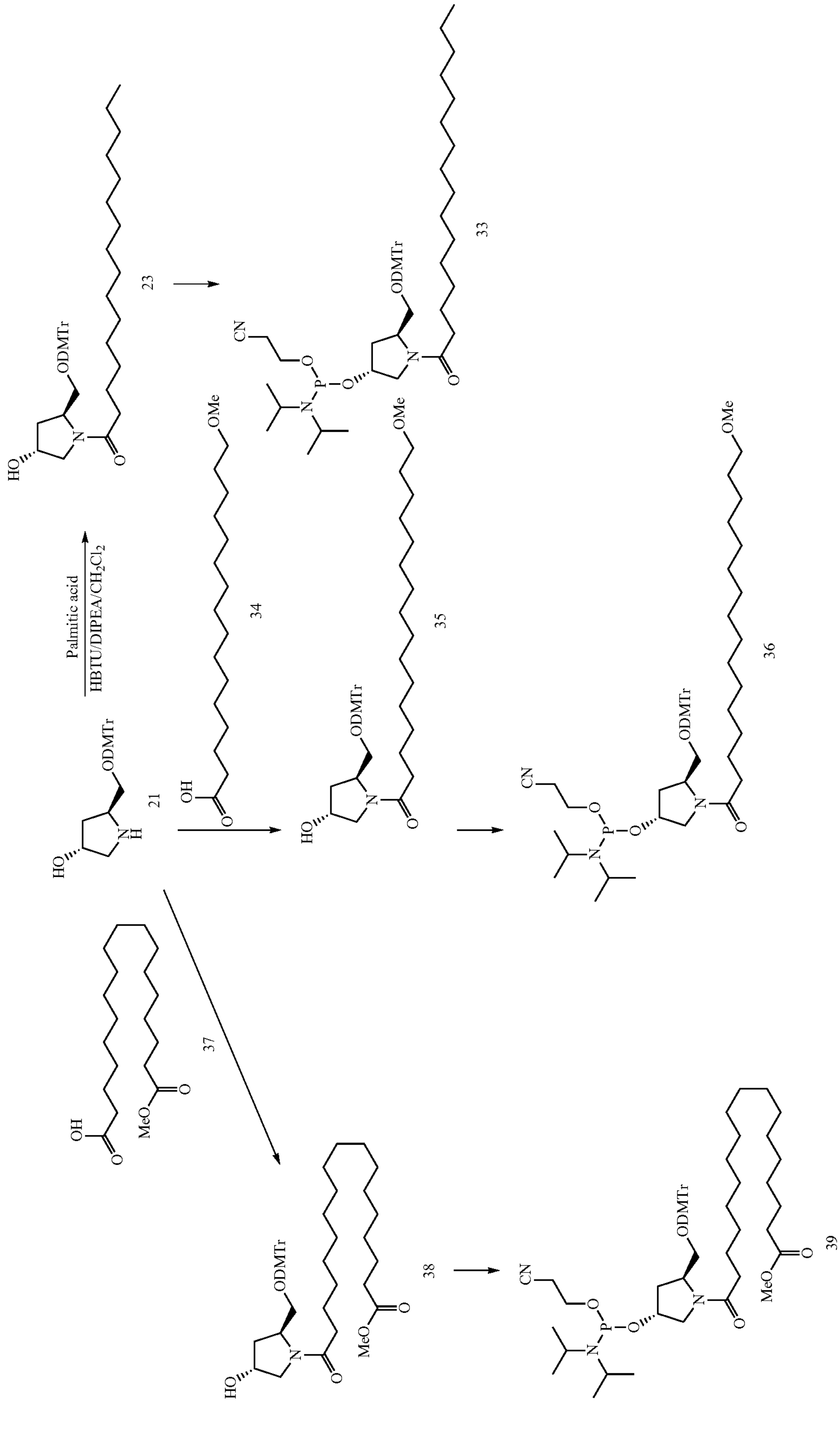
21 23 33 34 35 36 37 38 39

Compound 23: To a solution of palmitic acid (12.22 g, 47.67 mmol) and HBTU (19.89 g, 52.44 mmol) in Anhy. dichloromethane cooled to 0° C., DIPEA (24.91 mL, 143.02 mmol) was added dropwise. After stirring for 5 mins, Compound 21 (20 g, 47.67 mmol) was added to the reaction. The mixture was stirred at rt for 24 h, after which showed no presence of starting material (60% EtOAc in Hexanes). The reaction mixture was diluted with DCM and performed standard aqueous workup with sat. aq. $NaHCO_3$. The organic layers were combined, washed with sat. aq. NaCl, dried over anhy. Sodium sulfate and concentrated under reduced pressure. The residue was purified by flash chromatography on silica gel (pre-treated with $Et_3N$) with gradient 0-50% of EtOAc in Hexanes to afford 28.01 g (89%) of compound 23. $^1H$ NMR (500 MHz, DMSO-$d_6$) δ 7.36-7.26 (m, 5H), 7.23-7.16 (m, 6H), 6.90-6.83 (m, 5H), 4.96 (d, J=4.1 Hz, 1H), 4.39 (q, J=4.5 Hz, 1H), 4.18-4.07 (m, 2H), 3.73 (s, 8H), 3.58 (dd, J=10.6, 5.1 Hz, 1H), 3.17 (dd, J=8.9, 5.0 Hz, 1H), 3.02-2.94 (m, 2H), 2.69 (s, 12H), 2.20 (t, J=7.4 Hz, 2H), 2.06-1.90 (m, 2H), 1.83 (ddd, J=12.9, 8.5, 4.7 Hz, 1H), 1.46 (q, J=7.3 Hz, 2H), 1.30-1.16 (m, 28H), 0.87-0.81 (m, 4H).

Compound 33: Prior to reaction, compound 23 (9.57 g, 14.55 mmol) was co-evaporated with acetonitrile twice then dried on high vac overnight. Compound 23 was dissolved in anhy. dichloromethane (169.75 mL) and DIPEA (7.60 mL, 43.64 mmol) and 1-methylimidazole (579.7 uL, 7.27 mmol) were added dropwise. The mixture was cooled to 0° C. and chloro-2-cyanoethoxy-N,N-diisopropylaminophosphine (3.90 mL, 17.46 mmol) was added dropwise. The mixture was stirred at rt for 2 h and the reaction was checked by TLC (60% Hexanes in EtOAc), then solvent was removed under reduced pressure. The residue was resuspended in EtOAc and quickly performed aqueous work up with sat. aq. $NaHCO_3$. The organic layers were combined, washed with sat. aq. NaCl, dried over anhy. Sodium sulfate and concentrated under reduced pressure. The residue was purified by flash chromatography on silica gel (pre-treated with $Et_3N$) with gradient 0-30% of EtOAc in Hexanes to afford 10.11 g (81%) of compound 33 ($C_{16}H_{31}$). $^1H$ NMR (400 MHz, Acetonitrile-$d_3$) δ 7.39 (ddd, J=8.1, 4.0, 1.4 Hz, 3H), 7.32-7.18 (m, 11H), 6.88-6.79 (m, 6H), 4.69 (td, J=9.1, 4.7 Hz, 1H), 4.20 (ddq, J=7.6, 4.9, 2.5 Hz, 1H), 3.76 (s, 12H), 3.59 (ddt, J=13.5, 11.3, 6.8 Hz, 4H), 3.33 (ddd, J=14.7, 9.1, 4.6 Hz, 1H), 3.02 (td, J=8.9, 3.0 Hz, 1H), 2.62 (tq, J=6.0, 4.1 Hz, 3H), 2.29-2.19 (m, 3H), 1.54 (t, J=7.3 Hz, 2H), 1.33-1.21 (m, 35H), 1.20-1.11 (m, 20H), 0.91-0.84 (m, 4H). $^{31}P$ NMR (162 MHz, $CD_3CN$) δ 148.28, 147.41, 147.37, 147.23, 147.19, 146.85, 146.82.

Compound 35: To a solution of methyl ester lipid carboxylic acid 34 (2.15 g, 7.15 mmol) and HBTU (2.98 g, 7.87 mmol) in Anhy. dichloromethane cooled to 0° C., DIPEA (3.74 mL, 21.45 mmol) was added dropwise. After stirring for 5 mins, Compound 21 (3 g, 7.15 mmol) was added to the reaction. The mixture was stirred at rt for 24 h, which showed no presence of starting material (60% EtOAc in Hexanes). The reaction mixture was diluted with DCM and performed standard aqueous workup with sat. aq. $NaHCO_3$. The organic layers were combined, washed with sat. aq. NaCl, dried over anhy. Sodium sulfate and concentrated under reduced pressure. The residue was purified by flash chromatography on silica gel (pre-treated with $Et_3N$) with gradient 0-62% of EtOAc in Hexanes to afford 4.04 g (80%) of compound 35. $^1H$ NMR (500 MHz, DMSO-$d_6$) δ 7.35-7.25 (m, 7H), 7.24-7.15 (m, 8H), 6.90-6.83 (m, 6H), 4.95 (d, J=4.0 Hz, 1H), 4.42-4.35 (m, 1H), 4.20-4.07 (m, 2H), 3.73 (s, 9H), 3.57 (s, 5H), 3.27-3.15 (m, 2H), 2.98 (dt, J=8.9, 4.5 Hz, 2H), 2.69 (s, 9H), 2.27 (t, J=7.4 Hz, 3H), 2.23-2.17 (m, 2H), 2.04-1.96 (m, 2H), 1.87-1.79 (m, 1H), 1.53-1.43 (m, 5H), 1.22 (d, J=5.9 Hz, 31H).

Compound 36: Prior to reaction, compound 35 (4.04 g, 5.76 mmol) was co-evaporated with acetonitrile twice then dried on high vac overnight. Compound 35 was dissolved in anhy. dichloromethane (66.94 mL) and DIPEA (3.01 mL, 17.27 mmol) and 1-methylimidazole (458.7 uL, 5.76 mmol) were added dropwise. The mixture was cooled to 0° C. and chloro-2-cyanoethoxy-N,N-diisopropylaminophosphine (1.54 mL, 6.91 mmol) was added dropwise. The mixture was stirred at rt for 1.5 h and the reaction was checked by TLC (60% Hexanes in EtOAc), then solvent was removed under reduced pressure. The residue was resuspended in EtOAc and quickly performed aqueous work up with sat. aq. $NaHCO_3$. The organic layers were combined, washed with sat. aq. NaCl, dried over anhy. Sodium sulfate and concentrated under reduced pressure. The residue was purified by flash chromatography on silica gel (pre-treated with $Et_3N$) with gradient 0-30% of EtOAc in Hexanes to afford 4.09 g (79%) of compound 36. $^1H$ NMR (400 MHz, Acetonitrile-$d_3$) δ 7.39 (ddd, J=8.2, 4.0, 1.4 Hz, 6H), 7.33-7.15 (m, 20H), 6.88-6.79 (m, 11H), 4.69 (d, J=4.7 Hz, 1H), 4.21 (dp, J=7.8, 2.4 Hz, 2H), 3.85-3.67 (m, 24H), 3.59 (s, 16H), 3.38-3.27 (m, 2H), 3.02 (td, J=8.9, 3.0 Hz, 2H), 2.62 (tdd, J=7.5, 4.5, 2.9 Hz, 6H), 2.26 (q, J=7.5 Hz, 9H), 1.55 (h, J=7.5 Hz, 11H), 1.34-1.20 (m, 58H), 1.21-1.10 (m, 37H). $^{31}P$ NMR (162 MHz, $CD_3CN$) δ 149.70, 148.82, 148.80, 148.63, 148.60, 148.26, 148.23.

Compound 38: To a solution of methyl ester lipid carboxylic acid 37 (2.35 g, 7.15 mmol) and HBTU (2.98 g, 7.87 mmol) in Anhy. dichloromethane cooled to 0° C., DIPEA (3.74 mL, 21.45 mmol) was added dropwise. After stirring for 5 mins, Compound 21 (3 g, 7.15 mmol) was added to the reaction. The mixture was stirred at rt for 24 h, which showed no presence of starting material (60% EtOAc in Hexanes). The reaction mixture was diluted with DCM and performed standard aqueous workup with sat. aq. $NaHCO_3$. The organic layers were combined, washed with sat. aq. NaCl, dried over anhy. Sodium sulfate and concentrated under reduced pressure. The residue was purified by flash chromatography on silica gel (pre-treated with $Et_3N$) with gradient 0-68% of EtOAc in Hexanes to afford 4.44 g (85%) of compound 38. $^1H$ NMR (400 MHz, DMSO-$d_6$) δ 7.36-7.25 (m, 5H), 7.20 (td, J=8.9, 2.8 Hz, 6H), 6.90-6.83 (m, 5H), 4.97 (d, J=4.0 Hz, 1H), 4.39 (q, J=4.5 Hz, 1H), 3.73 (d, J=0.7 Hz, 8H), 3.57 (s, 4H), 3.17 (dd, J=8.9, 5.0 Hz, 1H), 3.01-2.94 (m, 2H), 2.69 (s, 15H), 2.27 (t, J=7.4 Hz, 3H), 2.20 (t, J=7.4 Hz, 2H), 2.04-1.96 (m, 1H), 1.83 (s, OH), 1.49 (q, J=5.6, 4.5 Hz, 2H), 1.22 (d, J=4.6 Hz, 30H).

Compound 39: Prior to reaction, compound 38 (4.44 g, 6.08 mmol) was co-evaporated with acetonitrile twice then dried on high vac overnight. Compound 38 was dissolved in anhy. dichloromethane (70.74 mL) and DIPEA (3.18 mL, 18.25 mmol) and 1-methylimidazole (484.8 uL, 6.08 mmol) were added dropwise. The mixture was cooled to 0° C. and chloro-2-cyanoethoxy-N,N-diisopropylaminophosphine (1.63 mL, 7.30 mmol) was added dropwise. The mixture was stirred at rt for 1.5 h and the reaction was checked by TLC (30% Hexanes in EtOAc), then solvent was removed under reduced pressure. The residue was resuspended in EtOAc and quickly performed aqueous work up with sat. aq. $NaHCO_3$. The organic layers were combined, washed with sat. aq. NaCl, dried over anhy. Sodium sulfate and concentrated under reduced pressure. The residue was purified by flash chromatography on silica gel (pre-treated with $Et_3N$) with gradient 0-30% of EtOAc in Hexanes to afford 4.43 g (78%) of compound 39. $^1$H NMR (400 MHz, Acetonitrile-$d_3$) δ 7.39 (ddd, J=8.1, 3.9, 1.4 Hz, 3H), 7.32-7.17 (m, 10H), 6.87-6.80 (m, 5H), 4.69 (ddq, J=13.6, 9.3, 4.3 Hz, 1H), 4.21 (ddt, J=7.7, 5.4, 2.6 Hz, 1H), 3.82-3.67 (m, 12H), 3.59 (s, 7H), 3.33 (ddd, J=14.7, 9.1, 4.6 Hz, 1H), 3.02 (td, J=8.9, 2.9 Hz, 1H), 2.62 (tq, J=6.0, 4.2 Hz, 3H), 2.25 (dt, J=14.0, 7.0 Hz, 4H), 2.19-2.13 (m, 3H), 1.55 (h, J=7.9, 7.2 Hz, 5H), 1.37-1.21 (m, 33H), 1.21-1.09 (m, 17H). $^{31}$P NMR (162 MHz, $CD_3CN$) δ 149.69, 148.81, 148.78, 148.62, 148.59, 148.55, 148.26, 148.22.
Synthesis of Hexadecyl Hydroxyprolinol Triphosphate
Scheme 8
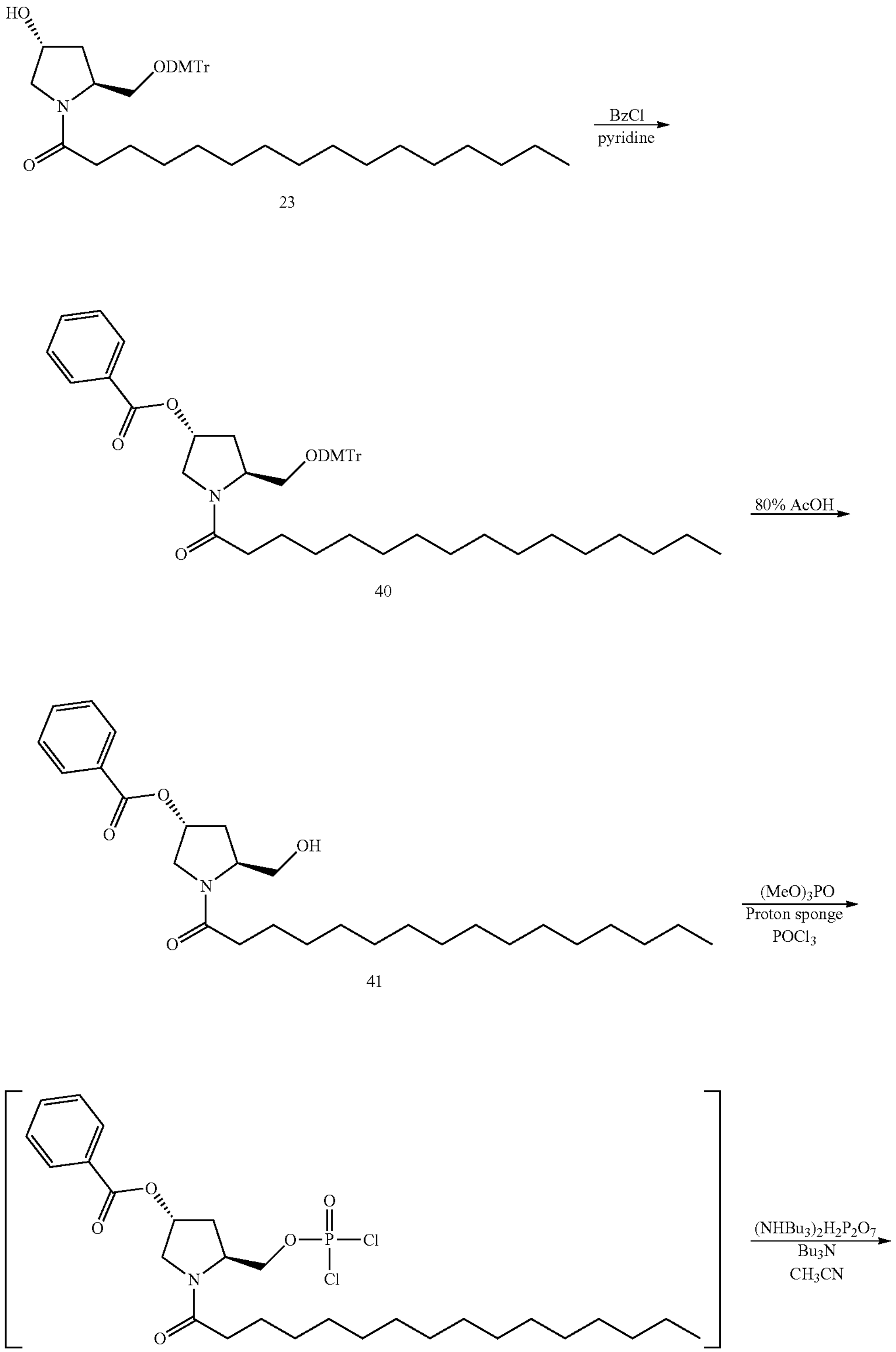
23
40
41

-continued

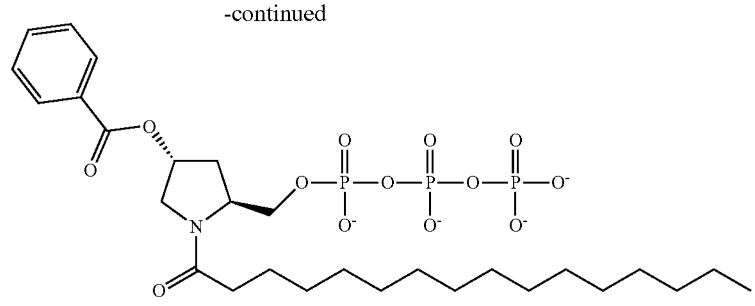

43

Compound 40: Prior to synthesis, the starting material, compound 23, was co-evaporated with pyridine twice and dried on high vac overnight. The starting material (1.01 g, 1.54 mmol) was dissolved in anh. pyridine (7.46 mL) and cooled to 0° C., and benzoyl chloride (214 μL, 1.84 mmol) was added dropwise. The mixture was stirred for 1 h at rt, and TLC was checked (80% hexanes in ethyl acetate). The solvent was stripped under reduced pressure, and the residue was resuspended in ethyl acetate. Standard aqueous workup was performed with sat. aq. $NaHCO_3$. The organic layers were combined, washed with sat. aq. NaCl, dried over anhy. Sodium sulfate and concentrated under reduced pressure. The residue was purified by flash chromatography on silica gel (pre-treated with $Et_3N$) with gradient 0-20% of EtOAc in Hexanes to afford 890 mg (76%) of compound 40. $^1H$ NMR (500 MHz, DMSO-$d_6$) δ 7.93 (ddt, J=12.8, 7.0, 1.4 Hz, 3H), 7.68-7.62 (m, 1H), 7.56-7.46 (m, 3H), 7.35 (ddt, J=8.1, 3.2, 1.8 Hz, 3H), 7.30 (q, J=7.9, 7.5 Hz, 3H), 7.27-7.17 (m, 7H), 6.88 (ddd, J=9.0, 6.1, 2.9 Hz, 6H), 5.60 (p, J=4.5 Hz, 1H), 4.29 (q, J=5.5, 5.1 Hz, 2H), 3.90 (ddd, J=28.0, 12.4, 3.9 Hz, 1H), 3.80-3.75 (m, 1H), 3.73 (d, J=1.0 Hz, 9H), 3.36 (s, 1H), 3.27 (dd, J=9.0, 4.7 Hz, 1H), 3.15-3.04 (m, 2H), 2.36-2.16 (m, 5H), 1.44 (q, J=7.4 Hz, 2H), 1.29-1.20 (m, 29H), 0.87-0.81 (m, 4H).

Compound 41: n a round bottom flask charged with a stir bar, compound 40 (890 mg, 1.17 mmol) was dissolved in 80% AcOH in water (13 mL). The mixture was stirred at rt for 48 h then the solvent was removed under reduced pressure. The residue was co-evaporated with toluene twice, then dried on high vac. The residue was purified by flash chromatography on silica gel (pre-treated with $Et_3N$) with gradient 0-60% of EtOAc in Hexanes to afford 301 mg (56%) of compound 41. $^1H$ NMR (500 MHz, DMSO-$d_6$) δ 7.97-7.89 (m, 3H), 7.66 (td, J=6.8, 6.1, 1.6 Hz, 1H), 7.51 (td, J=7.7, 6.0 Hz, 3H), 5.51-5.40 (m, 1H), 4.84 (t, J=5.5 Hz, 1H), 4.15 (dp, J=11.7, 3.8 Hz, 1H), 3.77 (dd, J=11.8, 5.0 Hz, 1H), 3.59 (dt, J=10.5, 5.2 Hz, 1H), 3.47 (ddd, J=14.8, 9.0, 4.7 Hz, 2H), 2.33-2.11 (m, 5H), 1.57-1.39 (m, 3H), 1.30-1.11 (m, 37H), 0.85 (t, J=6.8 Hz, 4H).

Compound 42: Prior to synthesis, the starting material, compound 41 (200 mg, 0.435 mmol), was dried on high vac overnight. In a RBF equipped with a stir bar, the starting material was charged with proton sponge (93 mg, 0.435 mmol) and trimethyl phosphate (1.81 mL, 15.64 mmol) at rt. The reaction flask was evacuated using a vacuum line then flushed with argon, repeated three times, then kept under argon. The mixture was stirred at rt for 10 min, then cooled to between −5 to −10° C. on ice and NaCl bath for 30 min. After cooling, phosphoryl chloride (28.30 μL, 0.305 mmol) was added via sealed glass syringe, stirred for 4 min, then added another portion of phosphoryl chloride (20.22 μL, 0.217 mmol) via sealed glass syringe. The mixture was stirred at −5 to −10° C. for 10 min. Pyrophosphate cocktail was prepared with tributylammonium pyrophosphate (255.50 mg, 0.348 mmol) dissolved in anh. Acetonitrile (1.75 mL) and tributylamine (621.95 μL, 2.61 mmol), and kept at −20° C. in dry ice/acetone bath. After stirring for 10 min, the pyrophosphate cocktail was quickly but carefully added dropwise to the cold reaction mixture, then stirred for additional 10 min. After removing the argon line from the flask, water (12 mL) was added via addition funnel. The mixture was transferred to a separatory funnel, and the aqueous layer was washed three time with dichloromethane (5 mL each). The aqueous layers were combined then the pH was adjusted to 6.5 using ammonium hydroxide (3 drops using syringe), and the mixture was stored at 4° C. overnight. The solvent was stripped off under reduced pressure, then remaining residue was frozen at −80° C. in acetone/dry ice bath. The residue was lyophilized overnight then submitted for $^{31}P$ NMR analysis in $D_2O$. $^{31}P$ NMR (202 MHz, $D_2O$) δ 3.72, −10.12, −20.99.

Synthesis of 2'-O—C6-amino-TFA uridine amidite

Scheme 9

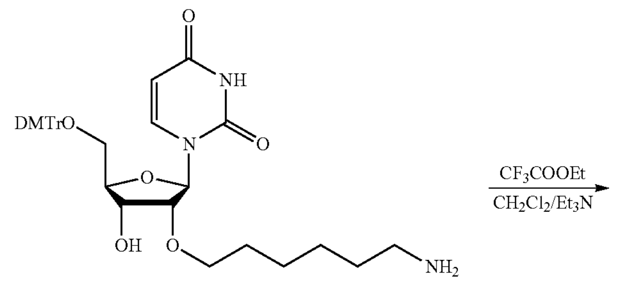

101

-continued

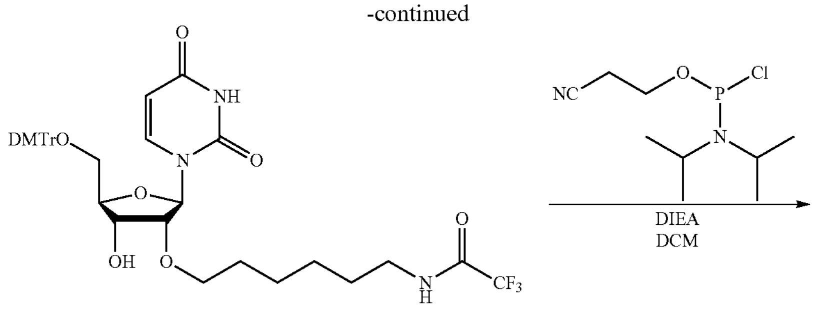

102

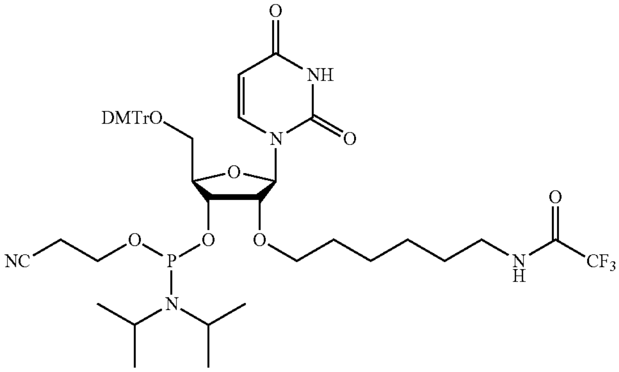

103

Compound 102: Compound 101 (5 g, 7.75 mmol) was added to a reaction flask. The starting material was dissolved in dichloromethane (50 ml) and triethylamine (4.23 ml, 31 mmol) was added via syringe. Ethyl trifluroacetate (2.75 g, 19.38 mmol) was added dropwise to the reaction. The reaction was stirred at room temperature overnight and checked by TLC (5% MeOH/DCM), developed using phosphomolybdic acid, and concentrated under reduced pressure. The residue was dissolved in dichloromethane, added to separation funnel and organic layer was washed with saturated sodium bicarbonate. The organic layer was separated and washed with a brine solution. The organic layer was separated and dried with sodium sulfate. The solid was filtered off and the mother liquor was concentrated and put on high vacuum to yield (4.32 g, 75%) of 102. $^1$H NMR (500 MHz, DMSO-d6) δ 11.36 (d, J=2.6 Hz, 2H), 9.36 (s, 1H), 7.71 (d, J=8.1 Hz, 2H), 7.36 (d, J=8.4 Hz, 4H), 7.31 (t, J=7.6 Hz, 4H), 7.27-7.20 (m, 10H), 6.89 (d, J=8.5 Hz, 8H), 5.78 (d, J=3.6 Hz, 2H), 5.27 (dd, J=8.1, 2.1 Hz, 2H), 5.10 (dd, J=6.7, 2.7 Hz, 2H), 4.16 (m, 2H), 3.95 (m, 2H), 3.88 (m, 2H), 3.73 (s, 13H), 3.55 (m, 4H), 3.36 (m, 1H), 3.28 (d, J=4.4 Hz, 1H), 3.22 (dd, J=10.9, 2.8 Hz, 2H), 3.14 (m, 3H), 2.11 (s, 2H), 1.48 (m, 8H), 1.36-1.19 (m, 8H). Mass calc. for $C_{38}H_{42}F_3N_3O_9$: 741.76, found: 740.2 (M-H).

Compound 103: Compound 102 (4.3 g, 5.8 mmol) was added to a reaction flask, evacuated and purged with argon. The starting material was dissolved in dichloromethane (40 ml) and diisopropylethylamine (2.02 ml, 11.6 mmol) was added via syringe. 2-Cyanoethyl N,N-diisopropylchlorophosphoramidite (1.93 ml, 8.7 mmol) was added and the reaction stirred at room temperature for 1 to 2 hours. The reaction was checked by TLC (75% EtOAc/Hex) and concentrated under reduced pressure. The residue was dissolved in ethyl acetate, added to separation funnel and organic layer was washed with saturated sodium bicarbonate. The organic layer was separated and washed with a brine solution. The organic layer was separated and dried with sodium sulfate. The solid was filtered off and the mother liquor was concentrated. The residue was purified by flash chromatography on silica gel (10% to 100% EtOAc/Hex) and the product fractions combined and concentrated on reduced pressure to yield (4.62 g, 85%) of 103. $^1$H NMR (400 MHz, Acetonitrile-d3) δ 9.06 (s, 1H), 7.74 (d, J=8.1 Hz, 1H), 7.49-7.39 (m, 2H), 7.39-7.21 (m, 7H), 6.93-6.83 (m, 4H), 5.84 (dd, J=7.0, 3.2 Hz, 1H), 5.21 (m, 1H), 4.45 (m, 1H), 4.20-3.97 (m, 3H), 3.91-3.79 (m, 1H), 3.77 (d, J=2.4 Hz, 7H), 3.63 (m, 4H), 3.48-3.31 (m, 3H), 3.23 (m, 1H), 2.67 (m, 1H), 2.52 (t, J=6.0 Hz, 1H), 2.08 (d, J=1.9 Hz, 1H), 1.64-1.45 (m, 4H), 1.42-1.28 (m, 4H), 1.27-1.09 (m, 9H), 1.05 (d, J=6.7 Hz, 3H). $^{31}$P NMR (162 MHz, Acetonitrile-d3) δ 149.53, 149.06. $^{19}$F NMR (376 MHz, Acetonitrile-d3) δ −83.43, −83.89 (d, J=2.4 Hz)

Synthesis of 2'-O—C3-amino-TFA uridine amidite

Scheme 10

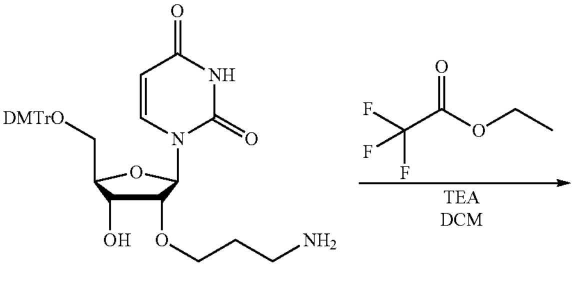

104

-continued

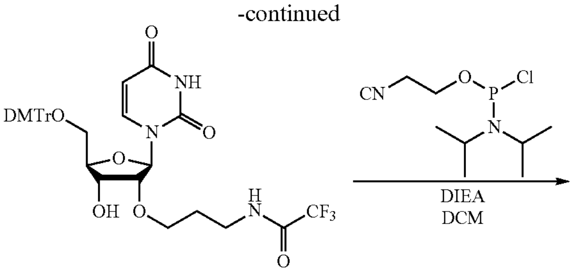

105

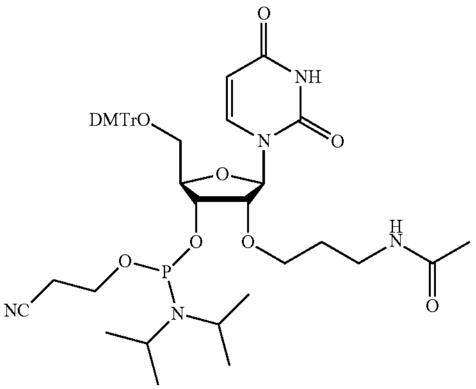

106

Compound 105: Compound 104 (2.5 g, 4.14 mmol) was added to a reaction flask. The starting material was dissolved in dichloromethane (20 ml) and triethylamine (2.26 ml, 16.56 mmol) was added via syringe. Ethyl trifluroacetate (1.47 g, 10.35 mmol) was added dropwise to the reaction. The reaction was stirred at room temperature overnight and checked by TLC (3% MeOH/DCM), developed using phosphomolybdic acid, and concentrated under reduced pressure. The residue was dissolved in dichloromethane, added to separation funnel and organic layer was washed with saturated sodium bicarbonate. The organic layer was separated and washed with a brine solution. The organic layer was separated and dried with sodium sulfate. The solid was filtered off and the mother liquor was concentrated. The residue was purified by flash chromatography on silica gel (0% to 10% MeOH/DCM) and the product fractions combined and concentrated on reduced pressure to yield (1.83 g, 63%) of 105. $^{1}$H NMR (400 MHz, DMSO-d6) δ 9.39 (m, 1H), 7.79 (d, J=8.1 Hz, 1H), 7.37 (d, J=7.3 Hz, 3H), 7.31 (t, J=7.5 Hz, 3H), 7.27-7.16 (m, 7H), 6.93-6.85 (m, 5H), 5.81-5.73 (m, 2H), 5.54 (d, J=4.9 Hz, 1H), 5.38 (d, J=8.1 Hz, 1H), 5.19 (dd, J=8.6, 6.4 Hz, 1H), 4.15-4.02 (m, 2H), 4.01-3.87 (m, 2H), 3.83-3.74 (m, 2H), 3.73 (s, 8H), 3.31-3.14 (m, 5H), 2.07 (s, 1H), 1.74 (dd, J=11.4, 4.6 Hz, 3H). $^{19}$F NMR (376 MHz, DMSO-d6) δ −81.24 (d, J=43.2 Hz). Mass calc. for $C_{35}H_{36}F_3N_3O_9$: 699.68, found: 698.2 (M-H).

Compound 106: Compound 105 (1.70 g, 2.43 mmol) was added to a reaction flask, evacuated and purged with argon. The starting material was dissolved in dichloromethane (2 ml) and diisopropylethylamine (0.846 ml, 4.86 mmol) was added via syringe. 2-Cyanoethyl N,N-diisopropylchlorophosphoramidite (0.649 ml, 2.92 mmol) was added and the reaction stirred at room temperature for 1 to 2 hours. The reaction was checked by TLC (50% EtOAc/Hex) and concentrated under reduced pressure. The residue was dissolved in ethyl acetate, added to separation funnel and organic layer was washed with saturated sodium bicarbonate. The organic layer was separated and washed with a brine solution. The organic layer was separated and dried with sodium sulfate. The solid was filtered off and the mother liquor was concentrated. The residue was purified by flash chromatography on silica gel (10% to 100% EtOAc/Hex) and the product fractions combined and concentrated on reduced pressure to yield (0.787 g, 36%) of 106. $^{1}$H NMR (400 MHz, Acetonitrile-d3) δ 7.89-7.63 (m, 2H), 7.49-7.39 (m, 2H), 7.38-7.20 (m, 7H), 6.88 (m, 4H), 6.13-5.97 (m, 1H), 5.53-5.34 (m, 1H), 4.52-4.32 (m, 2H), 4.24 (m, 1H), 3.94-3.80 (m, 4H), 3.80-3.74 (m, 7H), 3.71-3.53 (m, 5H), 3.52-3.29 (m, 3H), 3.25 (m, 2H), 2.64 (m, 3H), 1.86-1.75 (m, 2H), 1.36-0.96 (m, 25H). $^{19}$F NMR (376 MHz, Acetonitrile-d3) δ −77.26, −143.51. $^{31}$P NMR (202 MHz, Acetonitrile-d3) δ 152.03 (d, J=6.2 Hz), 151.47-150.50 (m).

Synthesis of 2'-O—C6-amide-C16 conjugated uridine amidite

Scheme 11

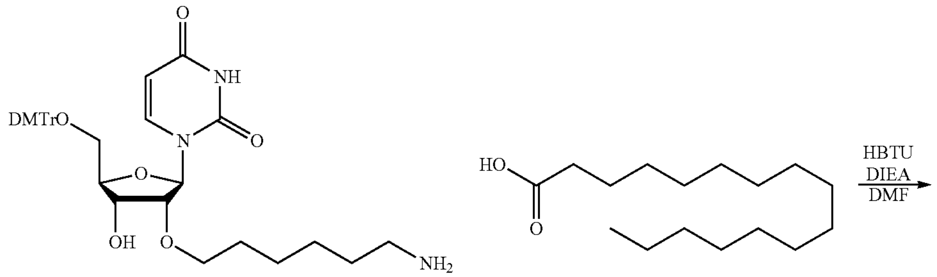

101

-continued

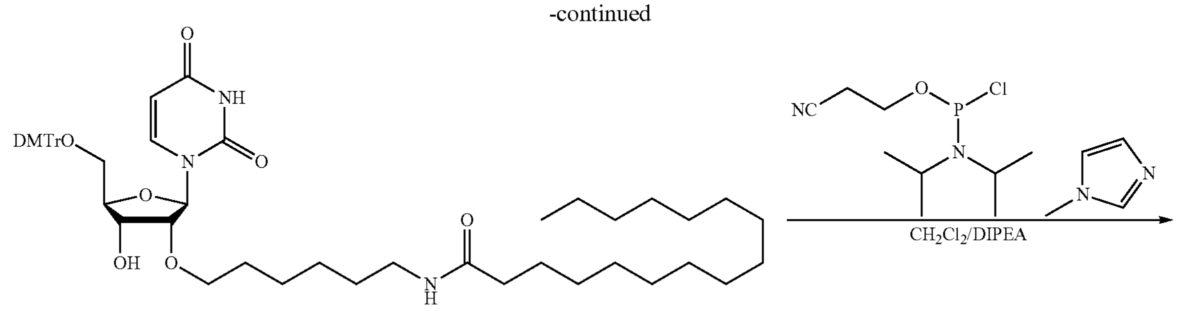

107

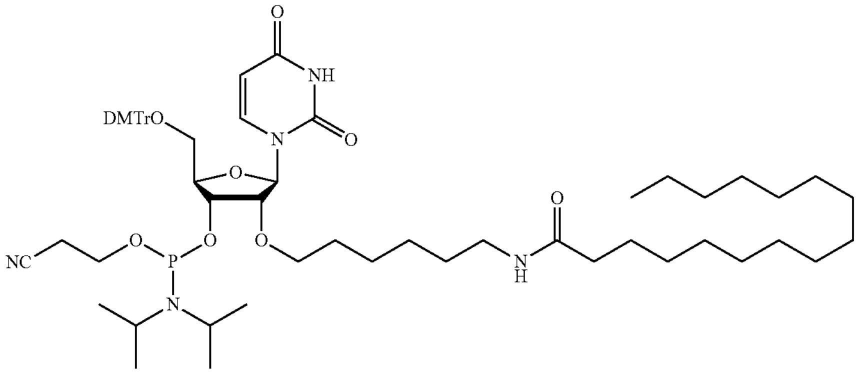

108

Compound 107: Compound 101 (5.7 g, 8.83 mmol) was added to a reaction flask, along with palmitic acid (2.51 g, 9.8 mmol) and HBTU (4.08 g, 10.77 mmol). The solids were dissolved in DMF (25 ml) and diisopropylethylamine (4.61 ml, 26.5 mmol) was added via syringe. The reaction was stirred at room temperature overnight. The reaction was checked by MS. The reaction was diluted with diethyl ether and dilute sodium bicarbonate solution and added to separation funnel. The organic layer was washed with dilute sodium bicarbonate solution, then saturated sodium bicarbonate, then saturated brine solution. The organic layer was separated and dried with sodium sulfate. The solid was filtered off and the mother liquor was concentrated. The residue was purified by flash chromatography on silica gel (0% to 100% EtOAc/Hex) and the product fractions combined and concentrated on reduced pressure to yield (6.33 g, 81%) of 107. $^{1}$H NMR (400 MHz, DMSO-d6) δ 11.40 (dd, J=27.8, 2.2 Hz, 1H), 7.76-7.63 (m, 2H), 7.33 (m, 4H), 7.23 (m, 5H), 6.89 (dd, J=9.3, 3.0 Hz, 4H), 5.78 (d, J=3.5 Hz, 1H), 5.27 (dd, J=8.1, 2.1 Hz, 1H), 5.21-5.07 (m, 1H), 4.26-4.06 (m, 1H), 3.91 (m, 2H), 3.73 (s, 6H), 3.63-3.43 (m, 2H), 3.29-3.18 (m, 2H), 2.98 (q, J=6.6 Hz, 2H), 2.00 (t, J=7.4 Hz, 2H), 1.47 (m, 4H), 1.34 (t, J=6.9 Hz, 2H), 1.21 (s, 23H), 0.83 (t, J=6.7 Hz, 3H). Mass calc. for $C_{52}H_{73}N_3O_9$: 884.17, found: 882.5 (M-H).

Compound 108: Compound 107 (5.83 g, 6.59 mmol) was added to a reaction flask, evacuated and purged with argon. The starting material was dissolved in dichloromethane (60 ml) and diisopropylethylamine (3.45 ml, 19.78 mmol) was added via syringe. Reaction was cooled to 0° C. via ice bath, then 2-Cyanoethyl N,N-diisopropylchlorophosphoramidite (1.91 ml, 8.57 mmol), then 1-methylimidazole (0.525 ml, 6.6 mmol) was added and the reaction was allowed to warm to room and stirred for 1 hour. The reaction was checked by TLC (80% EtOAc/Hex) and concentrated under reduced pressure. The residue was dissolved in dichloromethane, added to separation funnel and organic layer was washed with saturated sodium bicarbonate. The organic layer was separated and washed with a brine solution. The organic layer was separated and dried with sodium sulfate. The solid was filtered off and the mother liquor was concentrated. The residue was purified by flash chromatography on silica gel (10% to 80% EtOAc/Hex) and the product fractions combined and concentrated on reduced pressure to yield (4.6 g, 64%) of 108. $^{1}$H NMR (500 MHz, Acetonitrile-d3) δ 9.16 (s, 1H), 7.71 (d, J=8.1 Hz, 1H), 7.52-7.39 (m, 2H), 7.37-7.22 (m, 7H), 6.92-6.84 (m, 4H), 6.28 (d, J=7.2 Hz, 1H), 5.86 (dd, J=9.1, 3.7 Hz, 1H), 5.23 (t, J=8.2 Hz, 1H), 4.54-4.32 (m, 1H), 4.20-4.09 (m, 1H), 4.07-3.97 (m, 1H), 3.77 (d, J=2.8 Hz, 7H), 3.62 (m, 4H), 3.55-3.33 (m, 3H), 3.09 (m, 2H), 2.75 (s, 1H), 2.67 (m, 1H), 2.52 (s, 1H), 2.06 (m, 2H), 1.62-1.49 (m, 4H), 1.45-1.39 (m, 2H), 1.34 (m, 3H), 1.25 (d, J=16.3 Hz, 27H), 1.16 (dd, J=10.8, 6.8 Hz, 8H), 1.05 (d, J=6.8 Hz, 3H), 0.88 (t, J=6.9 Hz, 3H). $^{31}$P NMR (202 MHz, Acetonitrile-d3) δ 151.06, 150.60.

Synthesis of 2'-O—C3-amide-C16 conjugated uridine amidite

Scheme 12

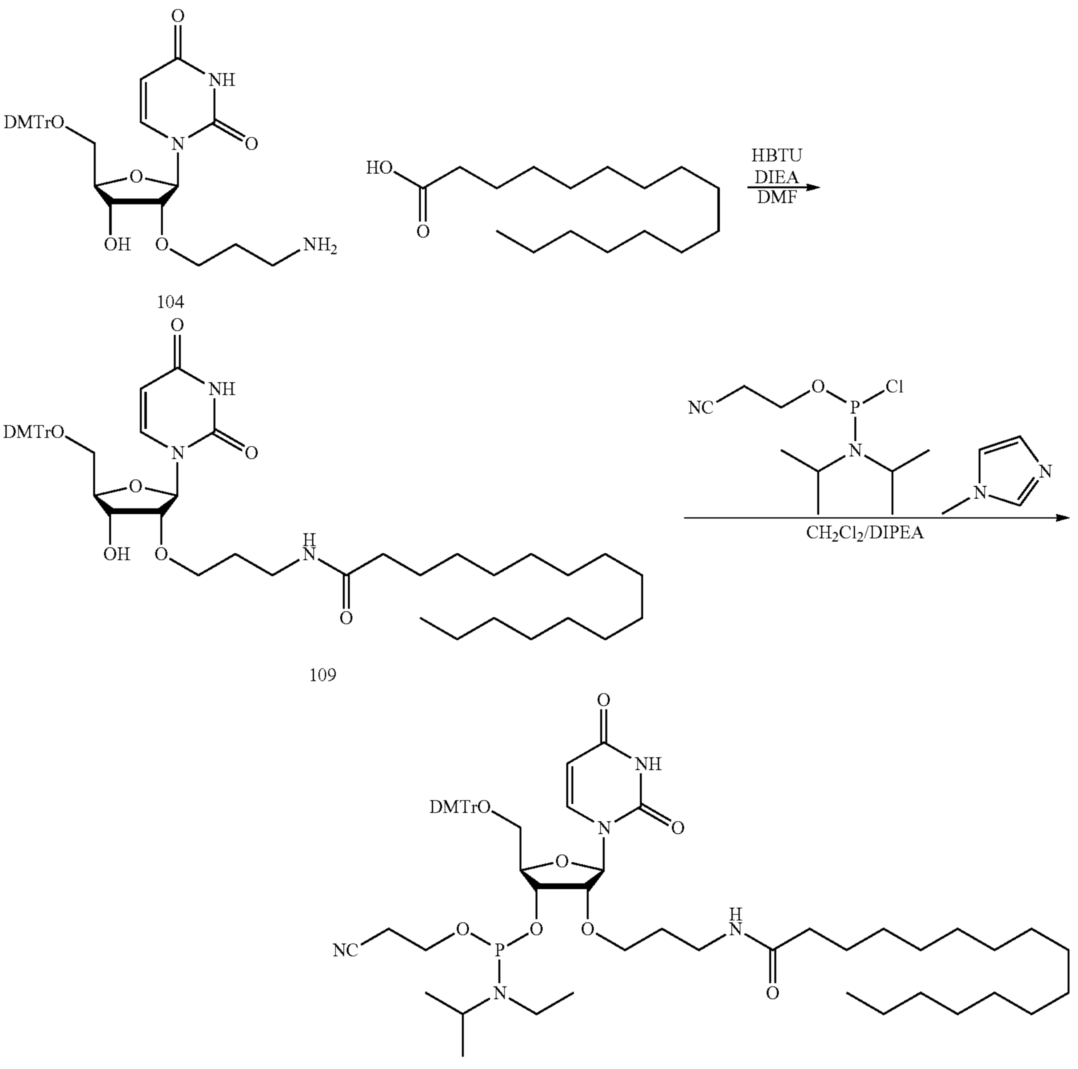

104

109

110

Compound 109: Compound 104 (5.3 g, 8.78 mmol) was added to a reaction flask, along with palmitic acid (2.50 g, 9.75 mmol) and HBTU (4.06 g, 10.71 mmol). The solids were dissolved in DMF (25 ml) and diisopropylethylamine (4.59 ml, 26.34 mmol) was added via syringe. The reaction was stirred at room temperature overnight. The reaction was checked by MS. The reaction was diluted with diethyl ether and dilute sodium bicarbonate solution and added to separation funnel. The organic layer was washed with dilute sodium bicarbonate solution, then saturated sodium bicarbonate, then saturated brine solution. The organic layer was separated and dried with sodium sulfate. The solid was filtered off and the mother liquor was concentrated. The residue was purified by flash chromatography on silica gel (0% to 100% EtOAc/Hex) and the product fractions combined and concentrated on reduced pressure to yield (4.66 g, 63%) of 109. $^1$H NMR (400 MHz, DMSO-d6) δ 11.37 (s, 1H), 7.75-7.67 (m, 2H), 7.34 (dd, J=19.6, 7.3 Hz, 4H), 7.29-7.14 (m, 6H), 6.89 (d, J=8.5 Hz, 4H), 5.78 (d, J=3.4 Hz, 1H), 5.27 (d, J=8.0 Hz, 1H), 5.19 (d, J=6.6 Hz, 1H), 4.18 (q, J=6.2 Hz, 1H), 3.92 (m, 2H), 3.73 (s, 6H), 3.57 (q, J=5.7, 5.0 Hz, 2H), 3.30-3.18 (m, 2H), 3.09 (m, 2H), 2.01 (t, J=7.4 Hz, 2H), 1.63 (m, 2H), 1.45 (t, J=7.2 Hz, 2H), 1.21 (d, J=5.1 Hz, 23H), 0.83 (t, J=6.7 Hz, 3H). Mass calc. for $C_{49}H_{67}N_3O_9$: 842.09, found: 840.5 (M-H).

Compound 110: Compound 109 (4.66 g, 5.53 mmol) was added to a reaction flask, evacuated and purged with argon. The starting material was dissolved in dichloromethane (40 ml) and diisopropylethylamine (2.89 ml, 16.6 mmol) was added via syringe. Reaction was cooled to 0° C. via ice bath, then 2-Cyanoethyl N,N-diisopropylchlorophosphoramidite (1.61 ml, 7.19 mmol), then 1-methylimidazole (0.441 ml, 5.53 mmol) was added and the reaction was allowed to warm to room and stirred for 2 hours. The reaction was checked by TLC (80% EtOAc/Hex) and concentrated under reduced pressure. The residue was dissolved in dichloromethane, added to separation funnel and organic layer was washed with saturated sodium bicarbonate. The organic layer was separated and washed with a brine solution. The organic layer was separated and dried with sodium sulfate. The solid was filtered off and the mother liquor was concentrated. The residue was purified by flash chromatography on silica gel (10% to 80% EtOAc/Hex) and the product fractions combined and concentrated on reduced pressure to yield (3.86 g, 67%) of 110. $^1$H NMR (500 MHz, Acetonitrile-d3) δ 9.01 (s, 1H), 7.74 (d, J=8.2 Hz, 1H), 7.52-7.40 (m, 3H), 7.36-7.21 (m, 7H), 6.92-6.85 (m, 4H), 6.40 (d, J=5.4 Hz, 1H), 5.85 (dd, J=7.6, 2.9 Hz, 1H), 5.21 (t, J=8.3 Hz, 1H), 4.46 (m, 1H), 4.22-4.09 (m, 2H), 4.09-3.98 (m, 2H), 3.91-3.80 (m, 1H), 3.80-3.69 (m, 9H), 3.68-3.55 (m, 3H), 3.55-3.34 (m, 3H), 3.22 (m, 2H), 2.75 (t, J=5.9 Hz, 1H), 2.68 (m, 1H), 2.52 (t, J=5.9 Hz, 1H), 2.06 (m, 2H), 1.71 (m, 2H), 1.54-1.49 (m, 2H), 1.25 (dd, J=9.5, 6.5 Hz, 28H), 1.22-1.10 (m, 10H), 1.05 (d, J=6.7 Hz, 3H), 0.88 (t, J=6.8 Hz, 3H). $^{31}$P NMR (202 MHz, Acetonitrile-d3) δ 151.01, 150.56.

Synthesis of 2'-O—C6-amide-C14 conjugated uridine amidite 8.6 mmol) and HBTU (3.58 g, 9.45 mmol). The solids were dissolved in DMF (25 ml) and diisopropylethylamine (4.05 ml, 23.23 mmol) was added via syringe. The reaction was stirred at room temperature overnight. The reaction was checked by TLC (80% EtOAc/Hex). The reaction was diluted with diethyl ether and dilute sodium bicarbonate solution and added to separation funnel. The organic layer was washed with dilute sodium bicarbonate solution, then saturated sodium bicarbonate, then saturated brine solution. The organic layer was separated and dried with sodium sulfate. The solid was filtered off and the mother liquor was concentrated. The residue was purified by flash chromatography on silica gel (0% to 100% EtOAc/Hex) and the product fractions combined and concentrated on reduced pressure to yield (3.78 g, 57%) of 111. $^1$H NMR (400 MHz, DMSO-d6) δ 11.37 (d, J=2.2 Hz, 1H), 7.72 (d, J=8.1 Hz, 1H), 7.67 (t, J=5.6 Hz, 1H), 7.41-7.28 (m, 4H), 7.23 (m, 5H), 6.89 (d, J=8.6 Hz, 4H), 5.78 (d, J=3.6 Hz, 1H), 5.27 (dd, Scheme 13

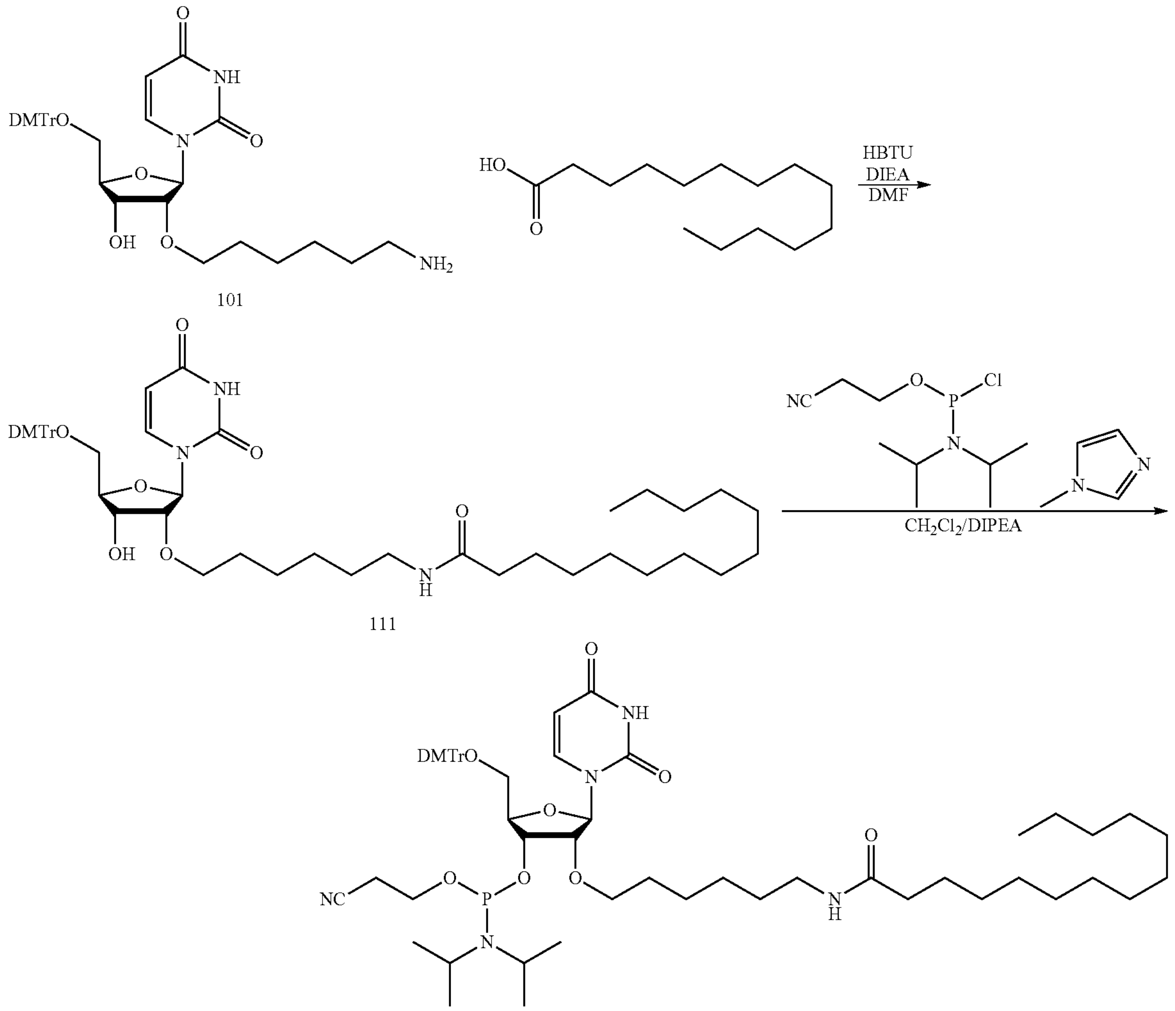

101

111

112

Compound 111: Compound 101 (5.0 g, 7.74 mmol) was added to a reaction flask, along with myristic acid (1.96 g, J=8.0, 2.1 Hz, 1H), 5.11 (d, J=6.6 Hz, 1H), 4.16 (q, J=6.2 Hz, 1H), 3.95 (m, 1H), 3.73 (s, 6H), 3.63-3.47 (m, 2H), 3.31-

3.18 (m, 3H), 2.98 (q, J=6.5 Hz, 2H), 2.00 (t, J=7.4 Hz, 2H), 1.47 (m, 4H), 1.34 (m, 3H), 1.21 (s, 23H), 0.83 (t, J=6.7 Hz, 3H).

Compound 112: Compound 111 (3.78 g, 4.42 mmol) was added to a reaction flask, evacuated and purged with argon. The starting material was dissolved in dichloromethane (40 ml) and diisopropylethylamine (2.31 ml, 13.25 mmol) was added via syringe. Reaction was cooled to 0° C. via ice bath, then 2-Cyanoethyl N,N-diisopropylchlorophosphoramidite (1.28 ml, 5.74 mmol), then 1-methylimidazole (0.352 ml, 4.42 mmol) was added and the reaction was allowed to warm to room and stirred for 1 hour. The reaction was checked by TLC (80% EtOAc/Hex) and concentrated under reduced pressure. The residue was dissolved in dichloromethane, added to separation funnel and organic layer was washed with saturated sodium bicarbonate. The organic layer was separated and washed with a brine solution. The organic layer was separated and dried with sodium sulfate. The solid was filtered off and the mother liquor was concentrated. The residue was purified by flash chromatography on silica gel (10% to 80% EtOAc/Hex) and the product fractions combined and concentrated on reduced pressure to yield (4.04 g, 87%) of 112. $^1$H NMR (400 MHz, Acetonitrile-d3) δ 9.18 (s, 1H), 7.44 (m, 2H), 7.38-7.21 (m, 7H), 6.93-6.83 (m, 4H), 6.29 (d, J=5.9 Hz, 1H), 5.86 (dd, J=7.4, 3.7 Hz, 1H), 5.23 (dd, J=8.1, 6.7 Hz, 1H), 4.53-4.33 (m, 1H), 4.15 (m, 1H), 4.08-3.97 (m, 1H), 3.86 (m, 1H), 3.77 (d, J=2.3 Hz, 6H), 3.62 (m, 4H), 3.48-3.32 (m, 2H), 3.09 (m, 2H), 2.67 (m, 1H), 2.52 (t, J=6.0 Hz, 1H), 2.06 (m, 2H), 1.54 (m, 4H), 1.41 (m, 2H), 1.26 (s, 25H), 1.16 (dd, J=8.7, 6.8 Hz, 10H), 1.05 (d, J=6.8 Hz, 3H), 0.92-0.83 (m, 3H). $^{31}$P NMR (202 MHz, Acetonitrile-d3) δ 151.06, 150.60.

Synthesis of 2'-O—C6-amide-C18 conjugated uridine amidite

Scheme 14

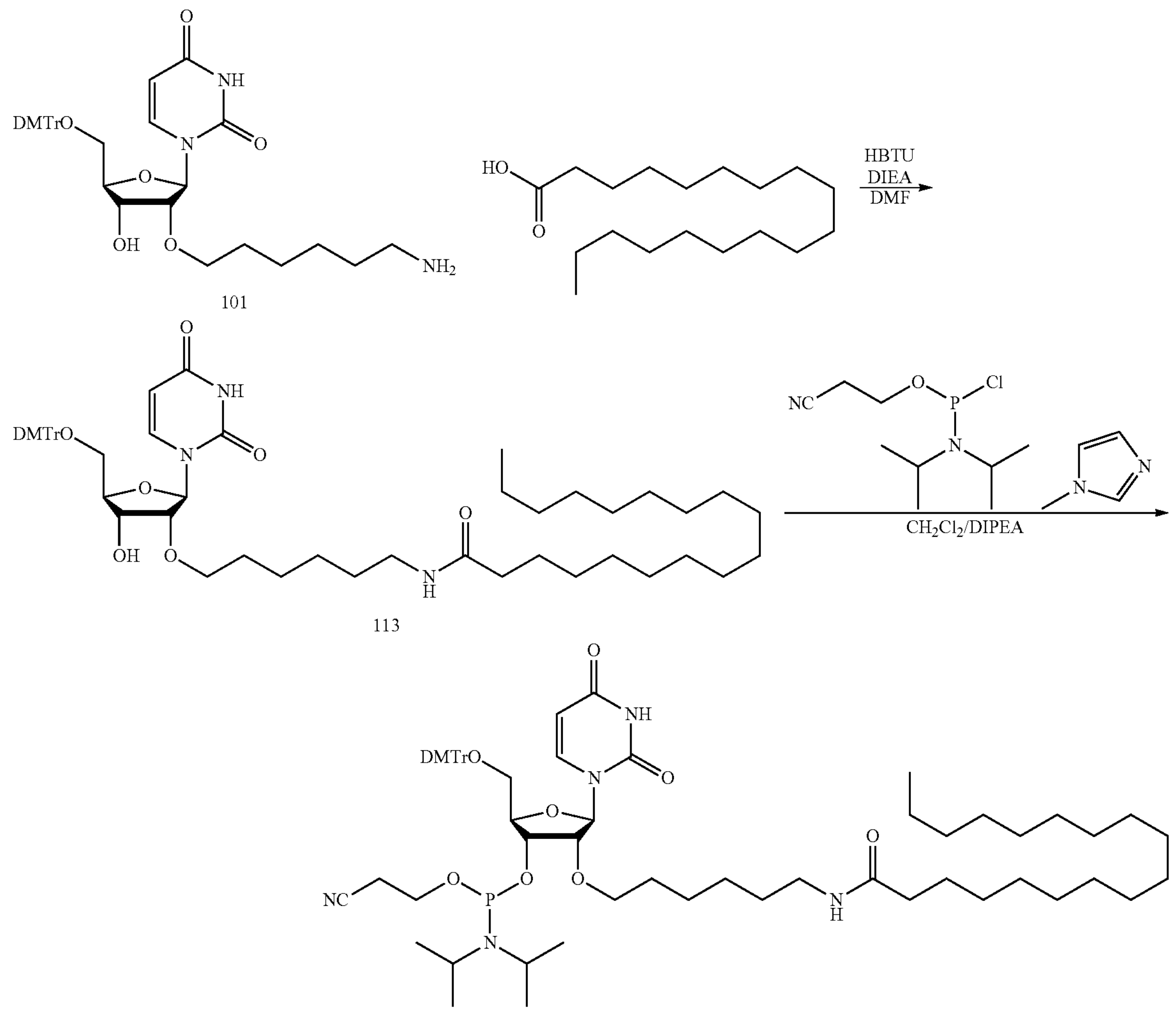

101

113

114

Compound 113: Compound 101 (5.0 g, 7.74 mmol) was added to a reaction flask, along with stearic acid acid (2.45 g, 8.6 mmol) and HBTU (3.58 g, 9.45 mmol). The solids were dissolved in DMF (25 ml) and diisopropylethylamine (4.05 ml, 23.23 mmol) was added via syringe. The reaction was stirred at room temperature overnight. The reaction was checked by TLC (80% EtOAc/Hex). The reaction was diluted with diethyl ether and dilute sodium bicarbonate solution and added to separation funnel. The organic layer was washed with dilute sodium bicarbonate solution, then saturated sodium bicarbonate, then saturated brine solution. The organic layer was separated and dried with sodium sulfate. The solid was filtered off and the mother liquor was concentrated. The residue was purified by flash chromatography on silica gel (0% to 100% EtOAc/Hex) and the product fractions combined and concentrated on reduced pressure to yield (3.56 g, 50%) of 113. $^1$H NMR (400 MHz, DMSO-d6) δ 11.36 (d, J=2.0 Hz, 1H), 7.72 (d, J=8.1 Hz, 1H), 7.67 (t, J=5.6 Hz, 1H), 7.42-7.27 (m, 4H), 7.27-7.18 (m, 5H), 6.89 (d, J=8.6 Hz, 4H), 5.78 (d, J=3.6 Hz, 1H), 5.27 (m, 1H), 5.11 (d, J=6.6 Hz, 1H), 4.16 (q, J=6.1 Hz, 1H), 4.02 (q, J=7.1 Hz, 1H), 3.95 (m, 1H), 3.87 (m, 1H), 3.73 (s, 6H), 3.63-3.47 (m, 2H), 3.31-3.18 (m, 2H), 2.98 (q, J=6.5 Hz, 2H), 2.04-1.95 (m, 2H), 1.48 (m, 4H), 1.34 (m, 3H), 1.30-1.15 (m, 31H), 0.83 (t, J=6.7 Hz, 3H).

Compound 114: Compound 113 (5.86 g, 6.44 mmol) was added to a reaction flask, evacuated and purged with argon. The starting material was dissolved in dichloromethane (60 ml) and diisopropylethylamine (3.36 ml, 19.31 mmol) was added via syringe. Reaction was cooled to 0° C. via ice bath, then 2-Cyanoethyl N,N-diisopropylchlorophosphoramidite (1.87 ml, 1.98 mmol), then 1-methylimidazole (0.513 ml, 6.44 mmol) was added and the reaction was allowed to warm to room and stirred for 1 hour. The reaction was checked by TLC (80% EtOAc/Hex) and concentrated under reduced pressure. The residue was dissolved in dichloromethane, added to separation funnel and organic layer was washed with saturated sodium bicarbonate. The organic layer was separated and washed with a brine solution. The organic layer was separated and dried with sodium sulfate. The solid was filtered off and the mother liquor was concentrated. The residue was purified by flash chromatography on silica gel (0% to 50% EtOAc/Hex) and the product fractions combined and concentrated on reduced pressure to yield (4.67 g, 65%) of 114. $^1$H NMR (400 MHz, Acetonitrile-d3) δ 9.17 (s, 1H), 7.49-7.39 (m, 2H), 7.37-7.21 (m, 7H), 6.93-6.83 (m, 4H), 6.29 (d, J=6.0 Hz, 1H), 5.86 (dd, J=7.4, 3.7 Hz, 1H), 5.23 (dd, J=8.1, 6.6 Hz, 1H), 4.43 (m, 1H), 4.21-4.09 (m, 1H), 4.09-3.96 (m, 2H), 3.87 (m, 1H), 3.77 (d, J=2.3 Hz, 6H), 3.61 (m, 4H), 3.46-3.32 (m, 2H), 3.09 (m, 2H), 2.73 (s, 1H), 2.67 (m, 1H), 2.52 (t, J=6.0 Hz, 1H), 2.06 (m, 2H), 1.54 (m, 4H), 1.41 (m, 2H), 1.26 (s, 31H), 1.16 (dd, J=8.8, 6.8 Hz, 11H), 1.05 (d, J=6.8 Hz, 3H), 0.88 (t, J=6.7 Hz, 3H). $^{31}$P NMR (202 MHz, Acetonitrile-d3) δ 151.06, 150.60.

Synthesis of 2'-O—C6-amide-oleyl conjugated uridine amidite

Scheme 15

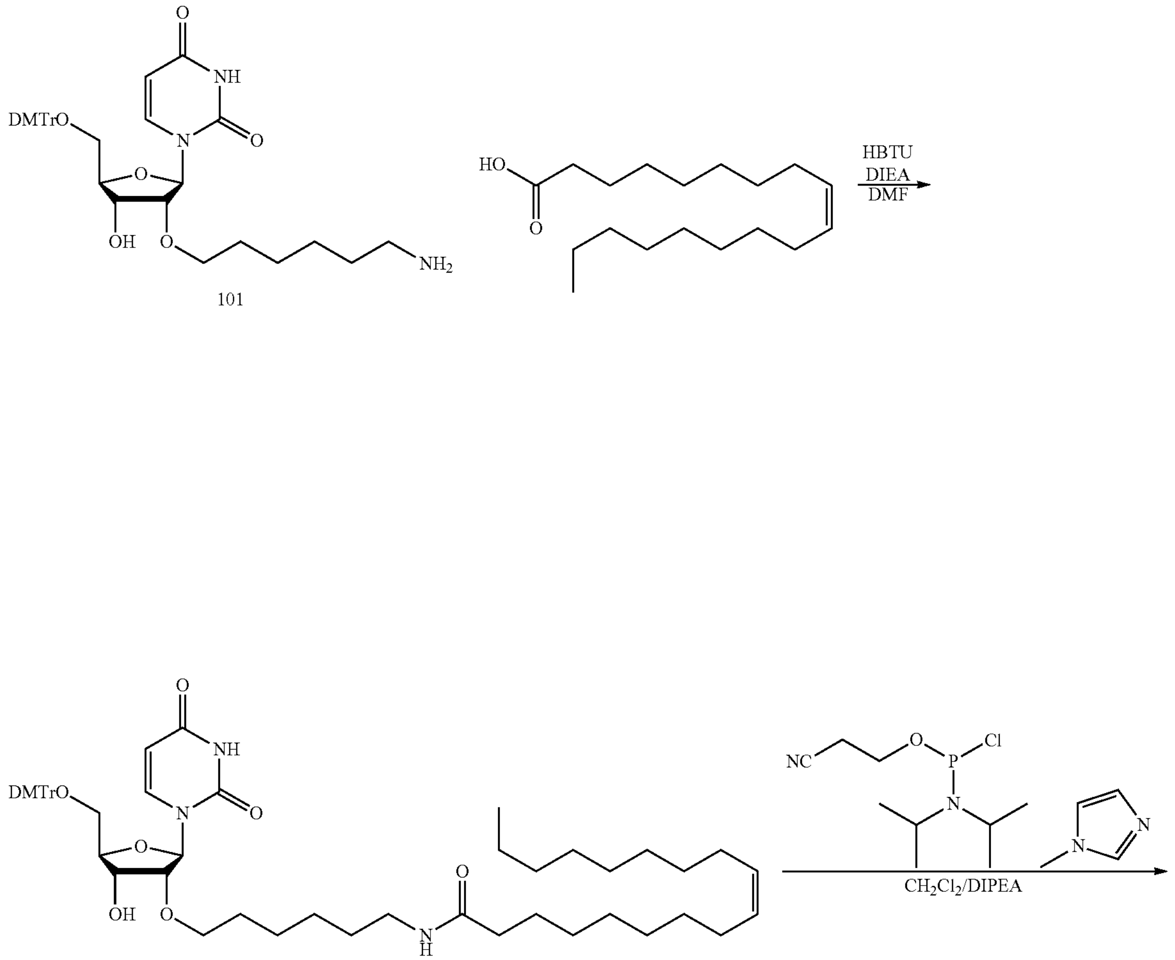

101

115

-continued

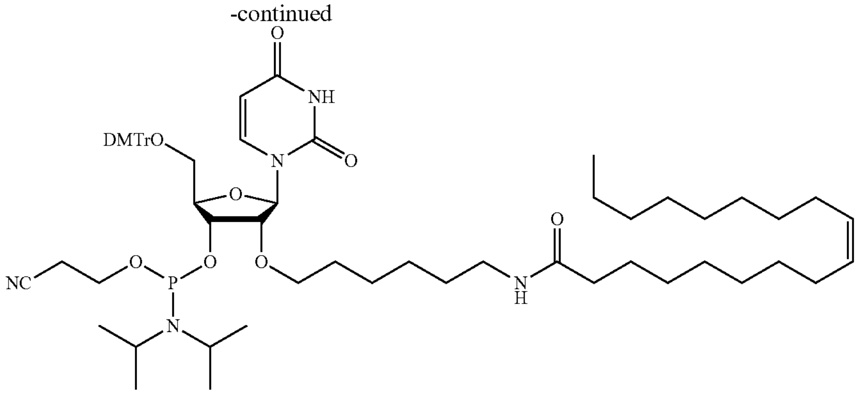

116

Compound 115: Compound 101 (5.0 g, 7.74 mmol) was added to a reaction flask, along with oleyl acid (2.43 g, 8.6 mmol) and HBTU (3.58 g, 9.45 mmol). The solids were dissolved in DMF (75 ml) and diisopropylethylamine (4.05 ml, 23.23 mmol) was added via syringe. The reaction was stirred at room temperature overnight. The reaction was checked by TLC (80% EtOAc/Hex). The reaction was diluted with diethyl ether and dilute sodium bicarbonate solution and added to separation funnel. The organic layer was washed with dilute sodium bicarbonate solution, then saturated sodium bicarbonate, then saturated brine solution. The organic layer was separated and dried with sodium sulfate. The solid was filtered off and the mother liquor was concentrated. The residue was purified by flash chromatography on silica gel (0% to 100% EtOAc/Hex) and the product fractions combined and concentrated on reduced pressure to yield (5.86 g, 84%) of 115. $^{1}$H NMR (400 MHz, DMSO-d6) δ 11.37 (d, J=2.0 Hz, 1H), 7.73 (d, J=8.1 Hz, 1H), 7.67 (t, J=5.6 Hz, 1H), 7.41-7.28 (m, 4H), 7.28-7.19 (m, 5H), 6.89 (d, J=8.7 Hz, 4H), 5.78 (d, J=3.6 Hz, 1H), 5.35-5.23 (m, 3H), 5.11 (d, J=6.7 Hz, 1H), 4.16 (q, J=6.2 Hz, 1H), 3.95 (m, 1H), 3.88 (m, 1H), 3.73 (s, 6H), 3.63-3.47 (m, 2H), 3.30-3.17 (m, 2H), 2.99 (q, J=6.5 Hz, 2H), 1.98 (m, 6H), 1.47 (m, 4H), 1.35 (q, J=7.0 Hz, 2H), 1.23 (d, J=12.7 Hz, 22H), 0.83 (t, J=6.7 Hz, 3H). Mass calc. for $C_{54}H_{75}N_3O_9$: 910.21, found: 908.5 (M-H).

Compound 116: Compound 115 (3.56 g, 3.90 mmol) was added to a reaction flask, evacuated and purged with argon. The starting material was dissolved in dichloromethane (35 ml) and diisopropylethylamine (2.04 ml, 11.71 mmol) was added via syringe. Reaction was cooled to 0° C. via ice bath, then 2-Cyanoethyl N,N-diisopropylchlorophosphoramidite (1.13 ml, 5.07 mmol), then 1-methylimidazole (0.311 ml, 3.9 mmol) was added and the reaction was allowed to warm to room and stirred for 1 hour. The reaction was checked by TLC (80% EtOAc/Hex) and concentrated under reduced pressure. The residue was dissolved in dichloromethane, added to separation funnel and organic layer was washed with saturated sodium bicarbonate. The organic layer was separated and washed with a brine solution. The organic layer was separated and dried with sodium sulfate. The solid was filtered off and the mother liquor was concentrated. The residue was purified by flash chromatography on silica gel (0% to 100% EtOAc/Hex) and the product fractions combined and concentrated on reduced pressure to yield (3.5 g, 80%) of 116. $^{1}$H NMR (500 MHz, Acetonitrile-d3) δ 9.16 (s, 1H), 7.48-7.40 (m, 2H), 7.38-7.22 (m, 7H), 6.92-6.84 (m, 4H), 6.28 (d, J=6.9 Hz, 1H), 5.86 (dd, J=9.2, 3.7 Hz, 1H), 5.34 (m, 2H), 5.23 (t, J=8.2 Hz, 1H), 4.51-4.36 (m, 1H), 4.15 (m, 1H), 4.07-3.97 (m, 1H), 3.93-3.81 (m, 1H), 3.77 (d, J=2.9 Hz, 7H), 3.61 (m, 4H), 3.45-3.33 (m, 2H), 3.09 (m, 2H), 2.81-2.69 (m, 1H), 2.69-2.58 (m, 1H), 2.52 (t, J=6.0 Hz, 1H), 2.10-1.97 (m, 6H), 1.54 (m, 4H), 1.47-1.39 (m, 2H), 1.39-1.19 (m, 25H), 1.16 (dd, J=10.8, 6.8 Hz, 9H), 1.05 (d, J=6.7 Hz, 3H), 0.88 (t, J=6.8 Hz, 3H). $^{31}$P NMR (202 MHz, Acetonitrile-d3) δ 151.06, 150.60.

Synthesis of 2'-O-C3-amide-oleyl conjugated uridine amidite

Scheme 16

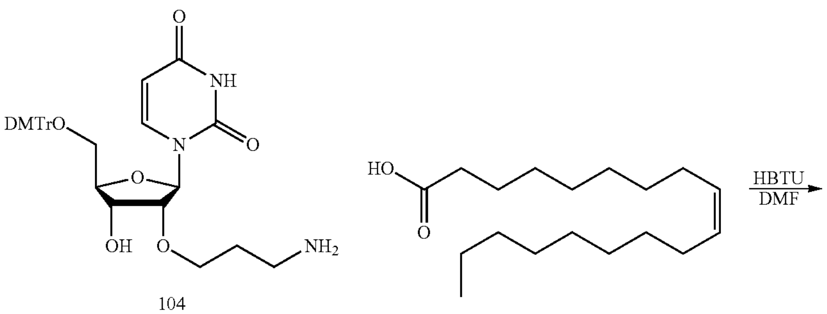

104

-continued

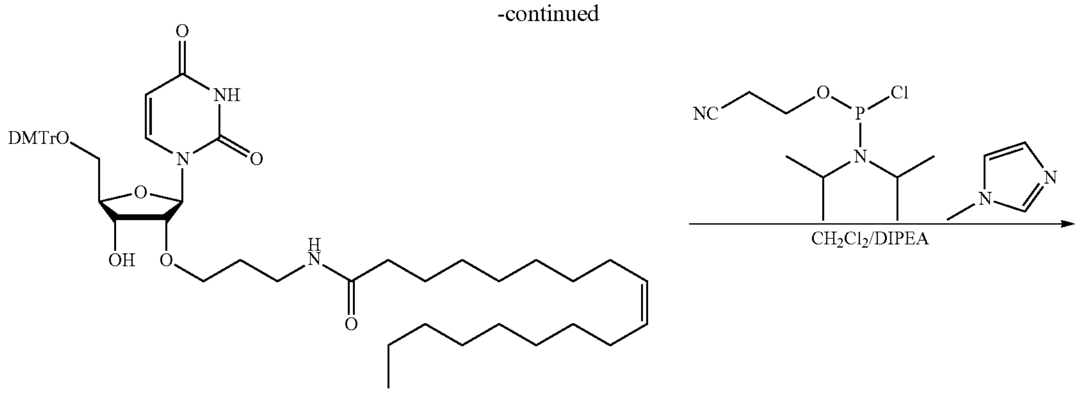

117

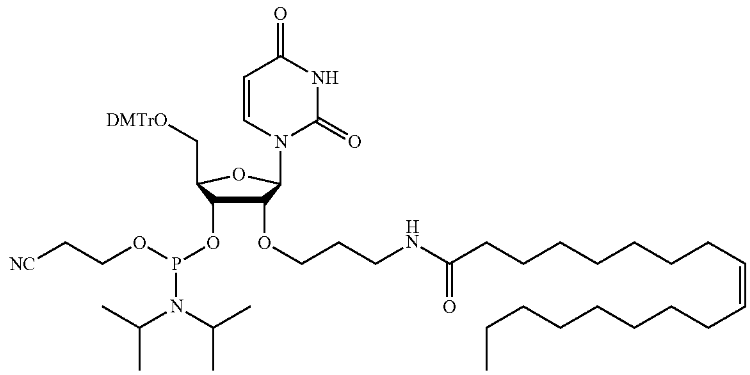

118

Compound 117: Compound 104 (5.0 g, 8.28 mmol) was added to a reaction flask, along with oleyl acid (2.6 g, 9.19 mmol) and HBTU (3.83 g, 10.11 mmol). The solids were dissolved in DMF (70 ml) and diisopropylethylamine (4.33 ml, 24.85 mmol) was added via syringe. The reaction was stirred at room temperature overnight. The reaction was checked by TLC (80% EtOAc/Hex). The reaction was diluted with diethyl ether and dilute sodium bicarbonate solution and added to separation funnel. The organic layer was washed with dilute sodium bicarbonate solution, then saturated sodium bicarbonate, then saturated brine solution. The organic layer was separated and dried with sodium sulfate. The solid was filtered off and the mother liquor was concentrated. The residue was purified by flash chromatography on silica gel (0% to 100% EtOAc/Hex) and the product fractions combined and concentrated on reduced pressure to yield (4.6 g, 64%) of 117. $^1$H NMR (400 MHz, DMSO-d6) δ 11.37 (d, J=2.2 Hz, 1H), 7.75-7.67 (m, 2H), 7.41-7.26 (m, 4H), 7.23 (m, 5H), 6.89 (d, J=8.5 Hz, 4H), 5.78 (d, J=3.4 Hz, 1H), 5.33-5.23 (m, 3H), 5.18 (d, J=6.6 Hz, 1H), 4.18 (q, J=6.3 Hz, 1H), 3.95 (m, 1H), 3.89 (dd, J=5.2, 3.5 Hz, 1H), 3.73 (s, 6H), 3.57 (q, J=5.6, 4.9 Hz, 2H), 3.31-3.18 (m, 2H), 3.09 (m, 2H), 2.05-1.90 (m, 6H), 1.63 (m, 2H), 1.45 (q, J=7.2 Hz, 2H), 1.23 (m, 20H), 0.83 (t, J=6.6 Hz, 3H). Mass calc. for $C_{51}H_{69}N_3O_9$: 868.13, found: 867.5 (M-H).

Compound 118: Compound 117 (4.6 g, 5.3 mmol) was added to a reaction flask, evacuated and purged with argon. The starting material was dissolved in dichloromethane (45 ml) and diisopropylethylamine (2.77 ml, 15.9 mmol) was added via syringe. Reaction was cooled to 0° C. via ice bath, then 2-Cyanoethyl N,N-diisopropylchlorophosphoramidite (1.54 ml, 6.89 mmol), then 1-methylimidazole (0.422 ml, 5.3 mmol) was added and the reaction was allowed to warm to room and stirred for 1 hour. The reaction was checked by TLC (80% EtOAc/Hex) and concentrated under reduced pressure. The residue was dissolved in dichloromethane, added to separation funnel and organic layer was washed with saturated sodium bicarbonate. The organic layer was separated and washed with a brine solution. The organic layer was separated and dried with sodium sulfate. The solid was filtered off and the mother liquor was concentrated. The residue was purified by flash chromatography on silica gel (0% to 60% EtOAc/Hex) and the product fractions combined and concentrated on reduced pressure to yield (4.64 g, 82%) of 118. $^1$H NMR (400 MHz, Acetonitrile-d3) δ 9.12 (s, 1H), 7.52-7.42 (m, 2H), 7.42-7.24 (m, 7H), 6.96-6.86 (m, 4H), 6.45 (d, J=4.9 Hz, 1H), 5.88 (dd, J=6.6, 2.8 Hz, 1H), 5.41-5.32 (m, 2H), 5.24 (dd, J=8.2, 7.2 Hz, 1H), 4.49 (m, 1H), 4.16 (m, 1H), 4.12-4.02 (m, 1H), 3.84-3.72 (m, 9H), 3.72-3.56 (m, 3H), 3.56-3.36 (m, 3H), 3.25 (m, 2H), 2.78 (t, J=5.9 Hz, 1H), 2.71 (m, 1H), 2.55 (t, J=6.0 Hz, 1H), 2.15-2.07 (m, 2H), 2.04 (m, 4H), 1.74 (m, F2H), 1.55 (d, J=7.2 Hz, 2H), 1.40-1.23 (m, 26H), 1.23-1.12 (m, 9H), 1.07 (d, J=6.8 Hz, 3H), 0.94-0.86 (m, 3H). $^{31}$P NMR (162 MHz, Acetonitrile-d3) δ 149.59 (d, J=2.2 Hz), 149.11 (d, J=2.6 Hz).

Synthesis of 2'-O—C3 uridine phosphoramidite

Scheme 17

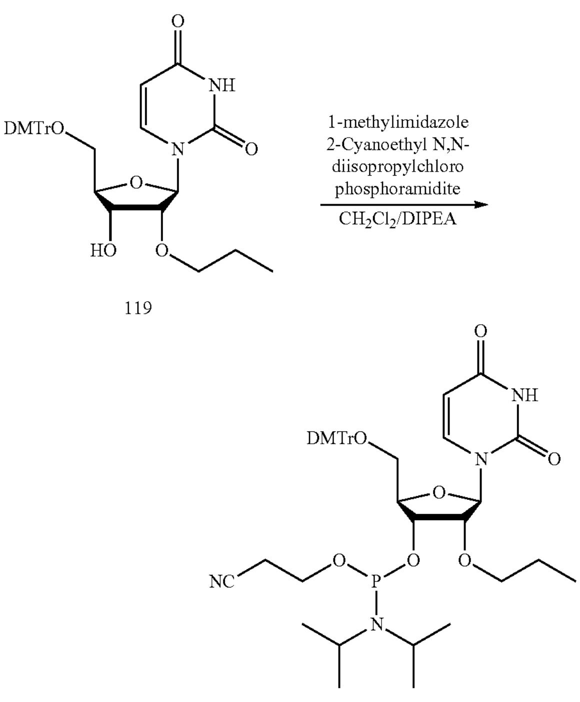

119

120

Compound 120: Prior to synthesis, the starting material, compound 119 (4.00 g, 6.80 mmol) was co-evaporated with acetonitrile twice then dried on high vac overnight. To a solution of compound 101 in anh. dichloromethane (79.03 mL), DIPEA (4.14 mL, 23.78 mmol) and 1-methylimidazole (541 μL, 6.80 mmol) were added. The mixture was cooled to 0° C. on ice bath and 2-cyanoethyl N,N-diisopropylchlorophosphoramidite (2.73 mL, 12.23 mmol) was added drop wise. The mixture was warmed to rt and stirred for 4 h, and TLC was checked (60% EtOAc in Hexanes). The solvent was stripped under reduced pressure and the residue was dried on high vac for 1 h. The residue was resuspended in EtOAc and quickly performed standard aqueous workup with sat. aq. $NaHCO_3$. The organic layers were combined, washed with sat. aq. NaCl, dried over anhy. sodium sulfate and concentrated under reduced pressure. The residue was purified by flash chromatography on silica gel (pre-treated with $Et_3N$) with gradient 0-60% of EtOAc in Hexanes to afford 4.53 g (84%) of compound 120. $^1$H NMR (400 MHz, Acetonitrile-$d_3$) δ 9.09 (s, 1H), 7.79 (dd, J=35.3, 8.1 Hz, 1H), 7.45 (ddt, J=10.6, 8.2, 1.3 Hz, 2H), 7.38-7.21 (m, 7H), 6.92-6.83 (m, 4H), 5.85 (dd, J=6.0, 3.2 Hz, 1H), 5.22 (dd, J=8.2, 5.3 Hz, 1H), 4.46 (dddd, J=31.1, 10.0, 6.6, 4.9 Hz, 1H), 4.15 (ddt, J=13.4, 6.3, 2.9 Hz, 1H), 4.04 (ddd, J=13.8, 4.9, 3.2 Hz, 1H), 3.80-3.73 (m, 7H), 3.68-3.54 (m, 3H), 3.45-3.37 (m, 2H), 2.70-2.63 (m, 1H), 2.15 (s, 1H), 1.64-1.52 (m, 2H), 1.16 (dd, J=9.9, 6.8 Hz, 9H), 1.05 (d, J=6.8 Hz, 3H), 0.91 (td, J=7.4, 5.2 Hz, 3H). $^{31}$P NMR (162 MHz, $CD_3CN$) δ 150.15, 150.10, 149.74, 149.69, 14.24, 6.08.

Synthesis of 2'-O—C6-amide-C16 ester Conjugated Uridine Amidite

Scheme 18

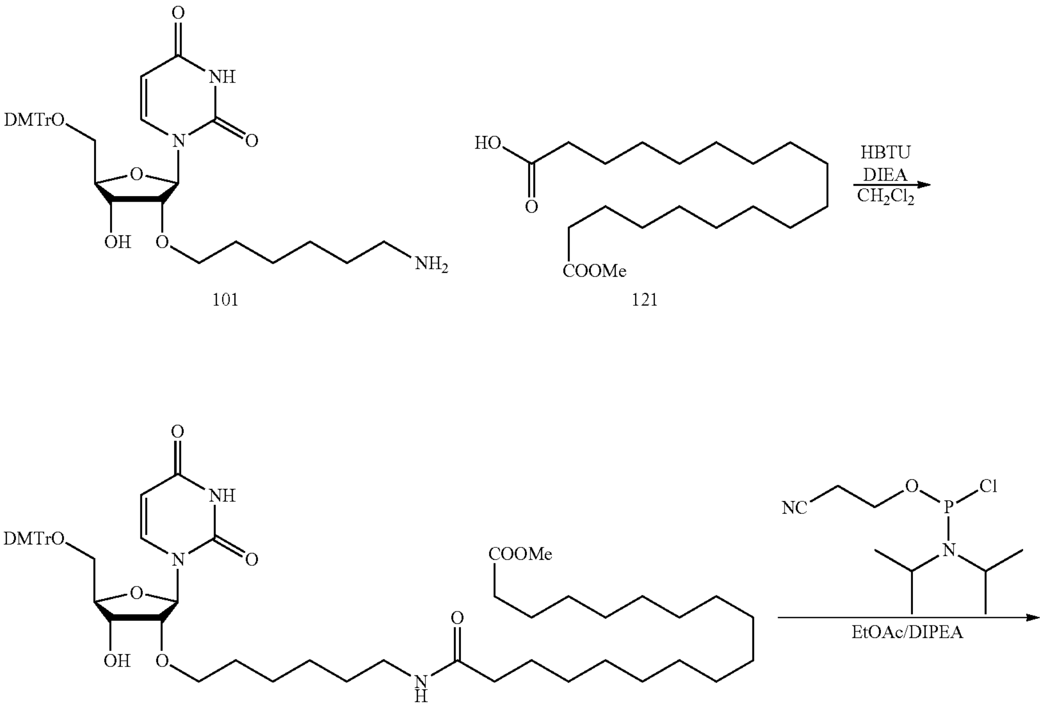

101

121

122

-continued

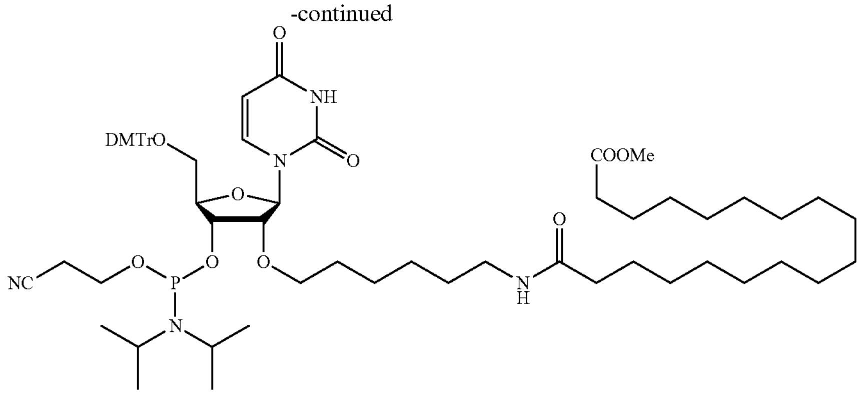

123

Compound 122: To a heat-oven dried 100 mL RBF, added a solution of compound 101, (4 g, 6.19 mmol, 1.0 equiv.) in anhydrous DCM (120 mL), 16-methoxy-16-oxohexadecanoic acid compound 121 (2.05 g, 6.81 mmol, 1.1 eq.) was added to the solution, followed by HBTU (2.58 g, 6.81 mmol, 1.1 eq) and DIPEA (3.24 mL, 18.58 mmol, 3 eq). The resultant solution was stirred at room temperature under argon overnight. TLC with 100% EtOAc/Hexane showed formation of product. The reaction mixture was quenched with brine solution, extracted with DCM. The combined organic solution was dried over anhydrous $Na_2SO_4$, filtered and concentrated to an oil. Purification through ISCO column chromatography with 80 g silica gel column eluted with 0-100% EtOAc/hexane gave 122. Yield a thick oil product (4.81 g, 84%). $^1$H NMR (500 MHz, Chloroform-d) δ 8.41 (s, 1H), 8.00 (d, J=8.2 Hz, 1H), 7.41-7.35 (m, 2H), 7.34-7.20 (m, 10H), 6.88-6.81 (m, 4H), 5.94 (d, J=1.9 Hz, 1H), 5.48 (t, J=5.6 Hz, 1H), 5.32-5.23 (m, 1H), 4.49-4.41 (m, 1H), 4.03 (dt, J=7.6, 2.4 Hz, 1H), 3.93-3.84 (m, 2H), 3.80 (d, J=1.1 Hz, 6H), 3.66 (s, 4H), 3.54 (qd, J=11.1, 2.4 Hz, 2H), 3.24 (td, J=7.2, 5.9 Hz, 2H), 2.80 (s, 10H), 2.75 (d, J=8.7 Hz, 1H), 2.30 (t, J=7.5 Hz, 2H), 2.18-2.11 (m, 2H), 1.49 (q, J=7.3 Hz, 2H), 1.29-1.23 (m, 17H).

Compound 123: The compound 7a (4.81 g, 5.18 mmol, 1 eq.) was dissolved in anhydrous EtOAc (120 mL). Under argon and cooled in an ice bath, added DIPEA (2.71 ml, 15.55 mmol, 3 eq.) followed by N,N-Diisopropylaminocyanoethyl phosphonamidic-Cl (1.35 g, 5.70 mmol, 1.1 eq.). After the addition, the reaction mixture was stirred at rt overnight. TLC at 100% EtOAc/Hexane showed completion of reaction. The reaction mixture was quenched with brine, extracted with EtOAc. The organic layer was separated and dried over $Na_2SO_4$. Concentrated to a white oil. ISCO purification eluted with 0-100% EtOAc/hexane gave 123. Yield 78.3%, 4.58 g product. $^1$H NMR (500 MHz, Acetonitrile-$d_3$) δ 9.41 (s, 1H), 7.90 (s, 1H), 7.78 (dd, J=42.9, 8.1 Hz, 1H), 7.48-7.40 (m, 2H), 7.38-7.21 (m, 7H), 6.92-6.84 (m, 4H), 6.39-6.32 (m, 1H), 5.86 (dd, J=9.1, 3.6 Hz, 1H), 5.45 (s, 3H), 5.24 (t, J=7.9 Hz, 1H), 4.15 (ddt, J=17.6, 6.1, 2.9 Hz, 1H), 4.07-3.98 (m, 1H), 3.77 (d, J=3.1 Hz, 8H), 3.66-3.56 (m, 7H), 3.47-3.34 (m, 2H), 3.13-3.05 (m, 2H), 2.73 (s, 8H), 2.71-2.62 (m, 1H), 2.26 (t, J=7.5 Hz, 2H), 2.06 (td, J=7.5, 2.2 Hz, 2H), 1.54 (dtd, J=13.4, 6.3, 3.4 Hz, 6H), 1.47-1.38 (m, 2H), 1.34 (t, J=7.3 Hz, 2H), 1.26 (d, J=6.2 Hz, 22H), 1.05 (d, J=6.8 Hz, 3H). $^{31}$P NMR (202 MHz, Acetonitrile-$d_3$) δ 151.59, 151.11.

Synthesis of 2'-O—C6-amide-C18 ester Conjugated Uridine Amidite

Scheme 19

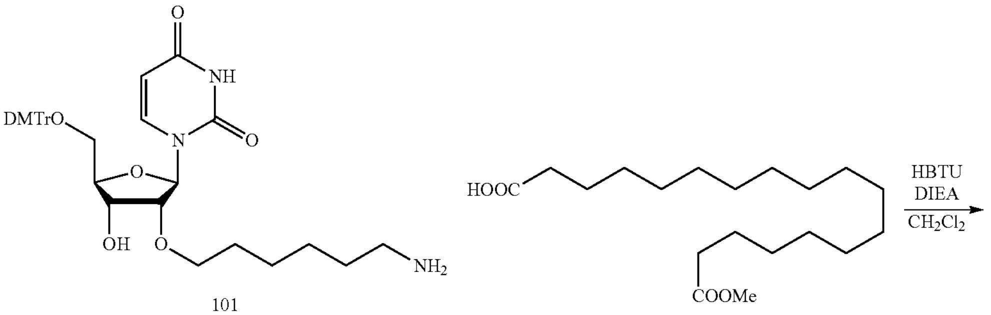

101

124

-continued

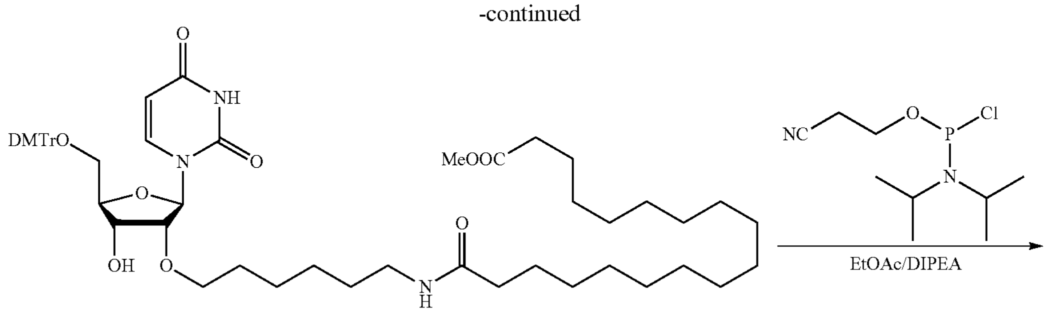

125

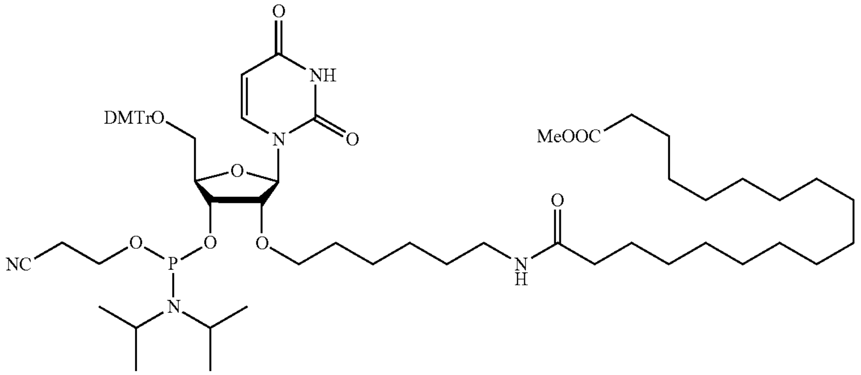

126

Compound 125: Compound 125 was obtained by using compound 101 and 18-methoxy-18-oxooctadecanoic acid 124 in a similar manner to compound 122 described above. $^{1}$H NMR (500 MHz, Chloroform-d) δ 8.57 (s, 1H), 8.00 (d, J=8.2 Hz, 1H), 7.41-7.35 (m, 2H), 7.33-7.20 (m, 9H), 6.88-6.81 (m, 4H), 5.51 (t, J=5.8 Hz, 1H), 5.31-5.24 (m, 1H), 4.45 (td, J=8.1, 5.2 Hz, 1H), 4.03 (dt, J=7.6, 2.4 Hz, 1H), 3.88 (td, J=6.6, 6.0, 4.5 Hz, 2H), 3.79 (d, J=1.1 Hz, 6H), 3.66 (s, 4H), 3.54 (qd, J=11.2, 2.4 Hz, 2H), 3.24 (td, J=7.2, 5.9 Hz, 2H), 2.80 (s, 11H), 2.76 (d, J=8.7 Hz, 2H), 2.30 (t, J=7.6 Hz, 2H), 2.18-2.07 (m, 2H), 1.48 (q, J=7.2 Hz, 2H), 1.29-1.23 (m, 21H).

Compound 126: Compound 126 was obtained by using compound 125 with N,N-Diisopropylaminocyanoethyl phosphonamidic-Cl in a similar manner to compound 123 described above. $^{1}$H NMR (500 MHz, Acetonitrile-$d_3$) δ 9.44 (s, 1H), 7.78 (dd, J=42.6, 8.2 Hz, 1H), 7.48-7.40 (m, 2H), 7.38-7.21 (m, 7H), 6.92-6.83 (m, 4H), 6.37 (q, J=5.6 Hz, 1H), 5.86 (dd, J=9.1, 3.5 Hz, 1H), 5.24 (dd, J=8.1, 7.1 Hz, 1H), 4.15 (ddt, J=17.5, 6.2, 2.9 Hz, 1H), 4.10-3.98 (m, 2H), 3.82-3.54 (m, 15H), 3.46-3.34 (m, 2H), 3.09 (tdd, J=7.0, 5.8, 3.3 Hz, 2H), 2.71-2.62 (m, 1H), 2.55-2.49 (m, 1H), 2.26 (t, J=7.5 Hz, 2H), 2.06 (td, J=7.4, 2.2 Hz, 2H), 1.61-1.49 (m, 6H), 1.41 (dtd, J=12.2, 7.2, 6.3, 3.4 Hz, 2H), 1.37-1.20 (m, 30H), 1.17-1.13 (m, 7H), 1.05 (d, J=6.8 Hz, 3H). $^{31}$P NMR (202 MHz, Acetonitrile-$d_3$) δ 151.36.

Synthesis of 2'-O—C6-amide-C20 ester Conjugated Uridine Amidite

Scheme 20

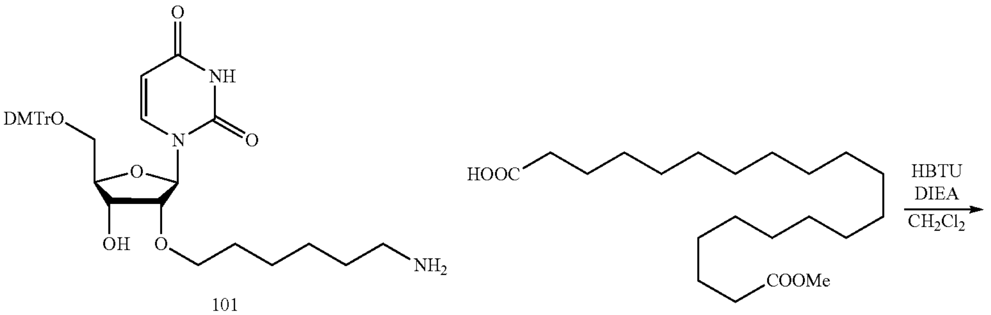

101

127

-continued

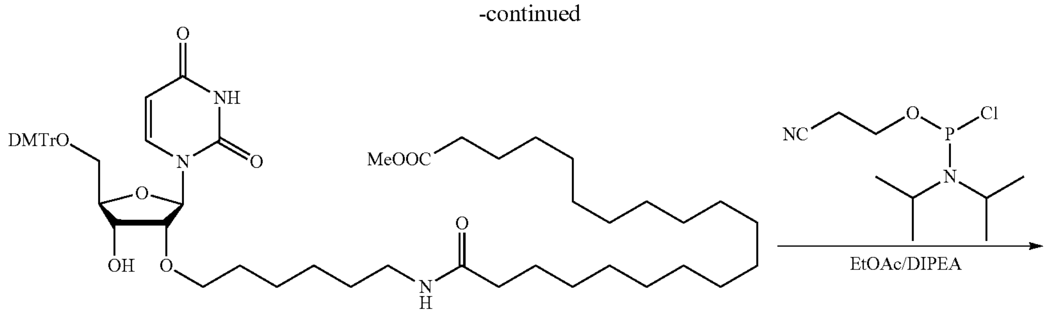

128

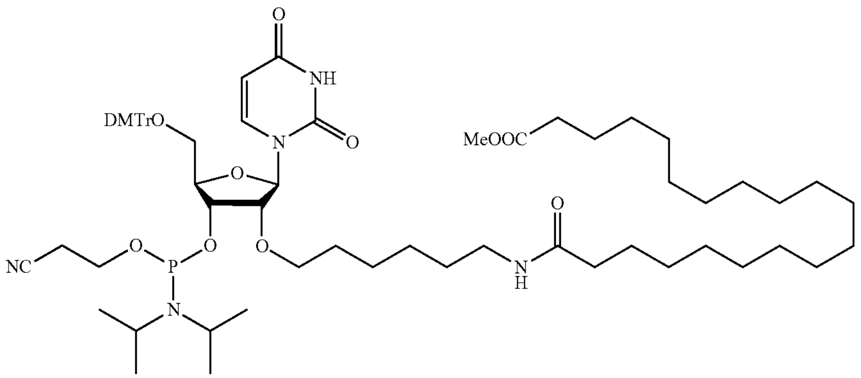

129

Compound 128: Compound 128 was obtained by using compound 101 and 20-methoxy-20-oxoicosanoic acid 127 in a similar manner to compound 128 described above. $^{1}H$ NMR (500 MHz, Chloroform-d) δ 8.00 (d, J=8.2 Hz, 1H), 7.41-7.35 (m, 2H), 7.34-7.21 (m, 10H), 6.88-6.81 (m, 4H), 5.94 (d, J=1.8 Hz, 1H), 5.27 (d, J=8.2 Hz, 1H), 4.45 (td, J=8.1, 5.3 Hz, 1H), 4.03 (dt, J=7.6, 2.5 Hz, 1H), 3.93-3.85 (m, 2H), 3.80 (d, J=1.0 Hz, 6H), 3.66 (s, 4H), 3.59-3.49 (m, 2H), 3.24 (q, J=6.8 Hz, 2H), 2.80 (s, 11H), 2.75 (d, J=8.6 Hz, 1H), 2.30 (t, J=7.6 Hz, 2H), 2.18-2.11 (m, 2H), 1.49 (q, J=7.3 Hz, 2H), 1.25 (d, J=6.6 Hz, 25H).

Compound 129: Compound 129 was obtained by using compound 128 with N,N-Diisopropylaminocyanoethyl phosphonamidic-Cl in a similar manner to compound 123 described above. $^{1}H$ NMR (400 MHz, Acetonitrile-$d_3$) δ 9.27 (s, 1H), 7.76 (dd, J=34.6, 8.1 Hz, 1H), 7.49-7.39 (m, 2H), 7.38-7.21 (m, 7H), 6.93-6.83 (m, 4H), 6.33 (d, J=5.9 Hz, 1H), 5.86 (dd, J=7.4, 3.6 Hz, 1H), 5.23 (dd, J=8.1, 6.3 Hz, 1H), 4.15 (ddt, J=13.6, 6.1, 2.9 Hz, 1H), 4.08-3.97 (m, 1H), 3.77 (d, J=2.3 Hz, 7H), 3.71-3.54 (m, 7H), 3.46-3.33 (m, 2H), 3.09 (qd, J=7.1, 2.5 Hz, 2H), 2.27 (t, J=7.5 Hz, 2H), 2.17 (s, 6H), 2.06 (td, J=7.4, 1.9 Hz, 2H), 1.61-1.47 (m, 6H), 1.47-1.37 (m, 3H), 1.26 (s, 32H), 1.18-1.12 (m, 7H), 1.05 (d, J=6.7 Hz, 3H). $^{31}P$ NMR (162 MHz, Acetonitrile-$d_3$) δ 151.08, 150.60 (d, J=7.1 Hz).

Synthesis of 2', 3'-O-hexadecyl Methyl Ester Uridine Phosphoramidites

Scheme 21

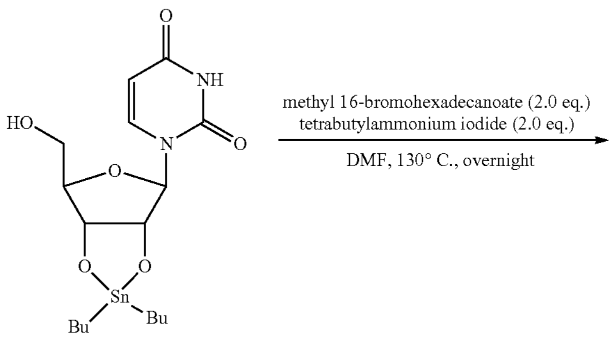

-continued
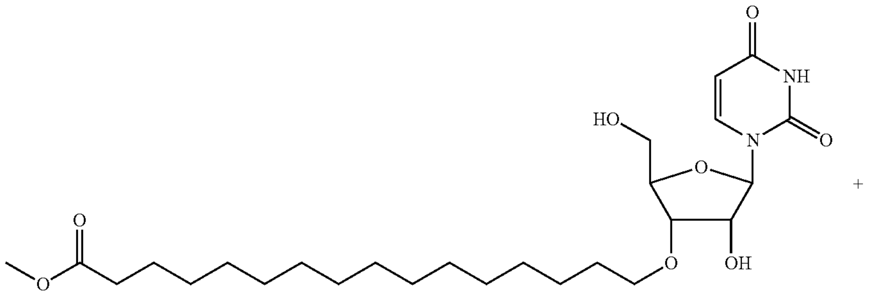
131
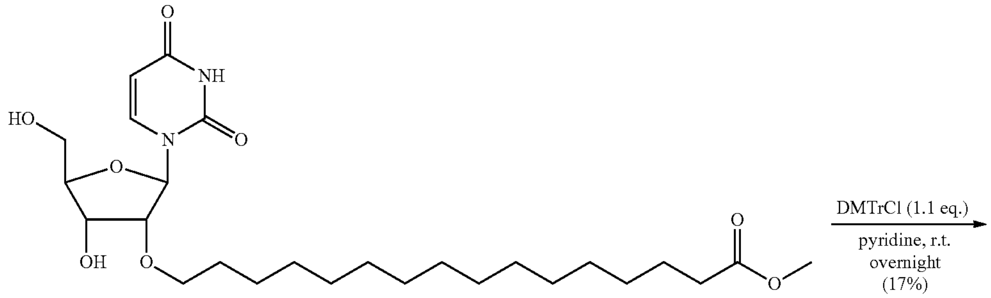
132
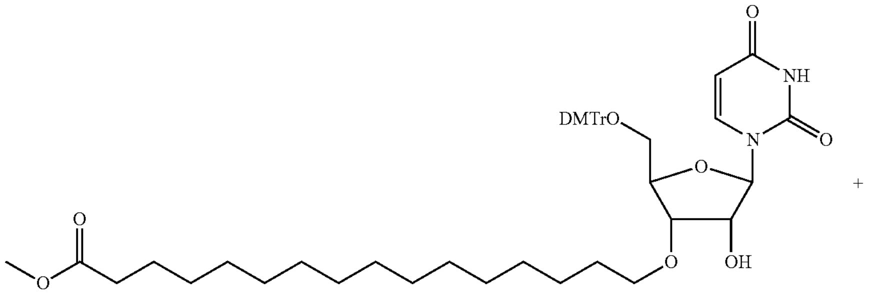
133
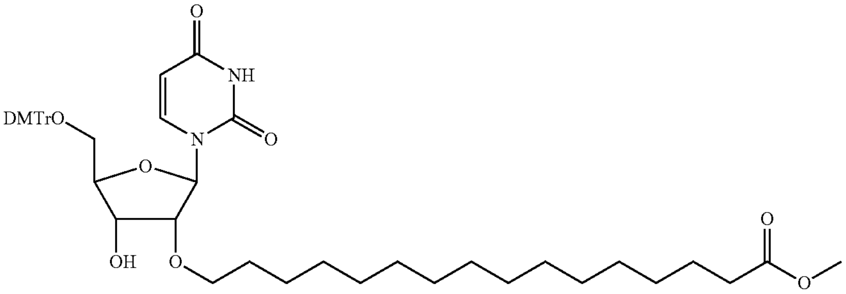
134
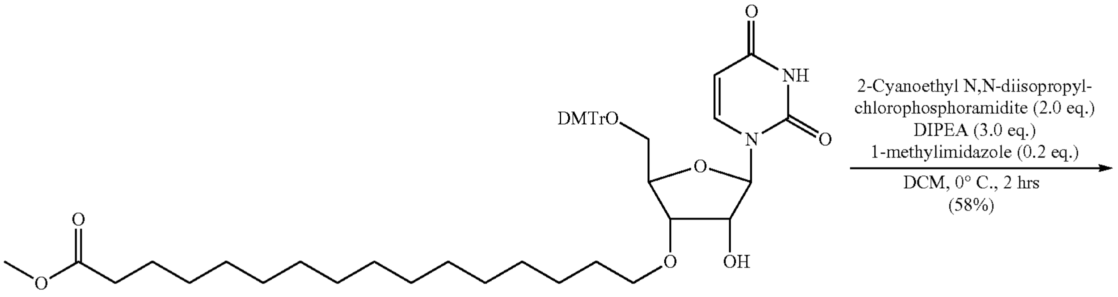
133

-continued

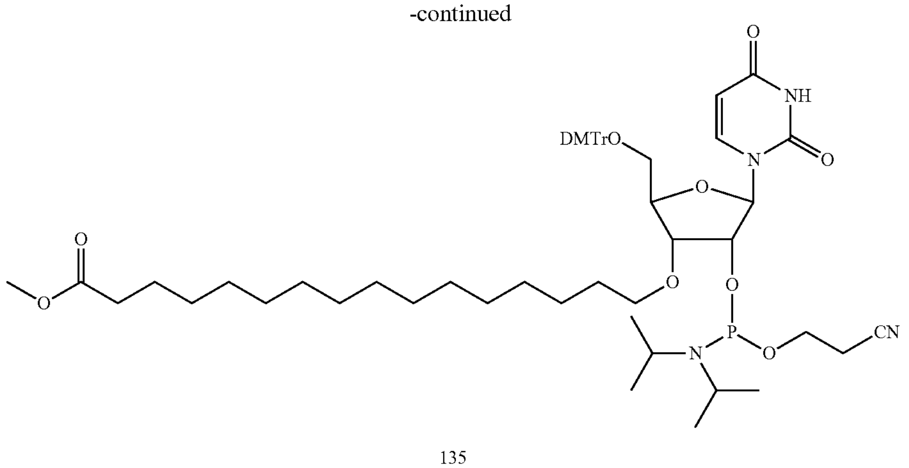

135

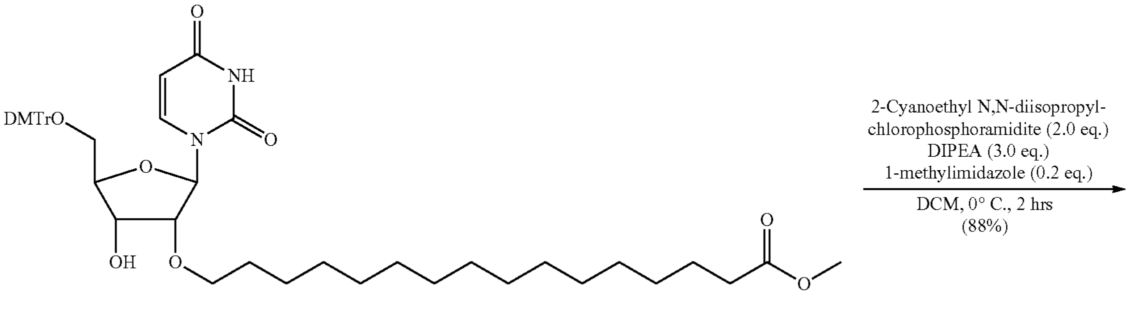

134

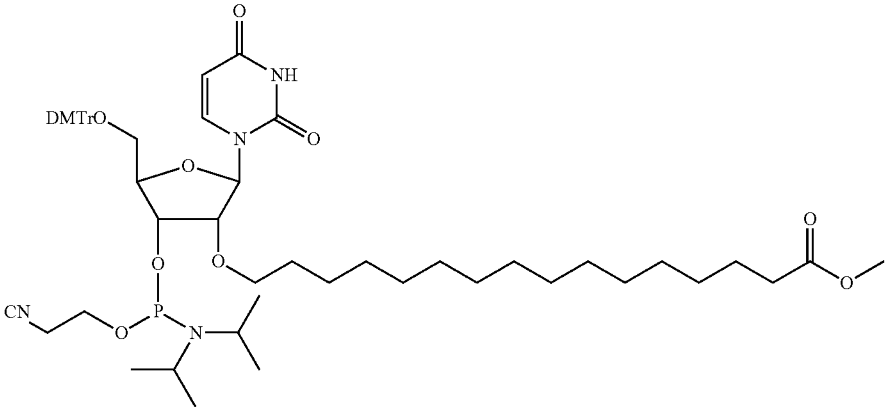

136

Compounds 131 and 132: To a solution of 2, 3'-O-dibutylstannylene uridine 130 (3.4 g, 7.15 mmol) in DMF (80 mL) was added methyl 16-bromohexadecanoate (5 g, 14.30 mmol) and tetrabutylammonium iodide (5.28 g, 14.30 mmol). The mixture was stirred at 130° C. in a reflux set-up overnight, forming a dark brown solution. The solution was eluted on silica (30% MeOH/DCM) and all UV active fractions were collected. The fractions were concentrated in vacuo and the product residue was purified on silica (5% MeOH/DCM) to obtain a crude mixture of 9 and 10 (3 g). 131: $^{1}$H NMR (500 MHz, DMSO-$d_6$) δ 11.3 (brs, 1H), 7.87 (d, 1H), 5.74 (d, 1H), 5.63 (d, 1H), 5.28 (brs, 1H), 5.10 (brs, 1H), 3.89-3.92 (m, 1H), 3.75 (t, 1H), 3.58-3.64 (m, 2H), 3.57 (s, 3H), 3.39-3.44 (m, 1H), 2.28 (t, 2H), 1.23 (s, 28H). $^{13}$C NMR (100 MHz, DMSO-$d_6$) δ 173.28, 171.91, 163.01, 150.67, 140.50, 101.63, 88.01, 82.75, 77.42, 72.59, 69.73, 60.75, 51.07, 33.22, 29.30, 28.98, 28.96, 28.90, 28.83, 28.79, 28.59, 28.38, 25.50, 24.37, 21.03, 132: $^{1}$H NMR (500 MHz, DMSO-$d_6$) δ 11.3 (brs, 1H), 7.92 (d, 1H), 5.83 (d, 1H), 5.63 (d, 1H), 5.10 (brs, 1H), 5.01 (d, 1H), 4.06-4.09 (m, 1H), 3.84-3.86 (m, 2H), 3.63 (brs, d, 1H), 3.57 (s, 3H), 3.40-3.47 (m, 1H), 2.28 (d, 2H), 1.23 (s, 28H).

Compound 133 and 134: Pyridine (10 mL) was added to a crude mixture of 131 and 132 (3 g, 5.85 mmol) and concentrated in vacuo to remove trace water. The mixture residue was placed under high vac. and back-filled with argon 3 times. A solution of 131 and 132 in pyridine (60 mL) was treated with 4,4'-dimethoxytrityl chloride (2.18 g, 6.44 mmol) and stirred at room temperature overnight under argon. The reaction was quenched with MeOH (10 mL) and concentrated in vacuo. The product residue was dissolved in 3% TEA/DCM and washed with saturated $NaHCO_3$ (aq.) and brine. The organic layer was dried with $Na_2SO_4$ and concentrated in vacuo. A silica column was neutralized by eluting 3% TEA/DCM 3 times before loading the product residue. The product was purified on silica (40-60% ethylacetate in 3% TEA/hexanes). 133 (390 mg, 7%) and 134 (610 mg, 10%) were separated and obtained as white solids. 134 $^1$H NMR (400 MHz, $CD_3CN$) δ 8.97 (brs, 1H), 7.73 (d, 1H), 7.42-7.45 (m, 2H), 7.22-7.35 (m, 7H), 6.86-6.90 (m, 4H), 5.72 (d, 1H), 5.45 (s, 1H), 5.29 (d, 1H), 4.24-4.25 (d, 1H), 4.02-4.10 (m, 2H), 3.78 (s, 6H), 3.60 (s, 3H), 3.44-3.48 (m, 1H), 3.31-3.35 (m, 1H), 2.28 (t, 2H), 1.54-1.57 (m, 4H), 1.26 (s, 24H).

Compound 135: Pyridine (3 mL) was added to 133 (390 mg, 0.479 mmol) and concentrated in vacuo to remove trace water 3 times. The residue was placed under high vac. and back-filled with argon 3 times. DCM (8 mL) was added to form a solution and placed in an ice bath with stirring. N,N-Diisopropylethylamine (250 uL, 1.44 mmol) and 1-methylimidazole (7.6 uL, 0.096 mmol) was added and stirred for 20 minutes at 0° C. 2-Cyanoethyl N,N-diisopropylchloro-phosphoramidite (214 uL, 0.957 mmol) was added and the solution was removed from the ice bath and stirred at room temperature for 2 hours. The product mixture was washed with saturated $NaHCO_3$ (aq.) and extracted with 3% TEA/DCM. The organic layer was dried with $Na_2SO_4$ and concentrated in vacuo. A silica column was neutralized by eluting 3% TEA/DCM 3 times before loading the product residue. The product was purified on silica (50% ethylacetate in 3% TEA/hexanes). 135 (280 mg, 58%) was obtained as a white solid. $^{31}$P NMR (202 MHz, $CD_3CN$) δ 150.62 (s), 152.00 (s).

Compound 136: Pyridine (8 mL) was added to 134 (610 mg, 0.748 mmoL) and concentrated in vacuo to remove trace water 3 times. The residue was placed under high vac. and back-filled with argon 3 times. DCM (12 mL) was added to form a solution and placed in an ice bath with stirring. N,N-Diisopropylethylamine (391 uL, 2.25 mmol) and 1-methylimidazole (11.9 uL, 0.147 mmol) was added and stirred for 20 minutes at 0° C. 2-Cyanoethyl N,N-diisopropylchloro-phosphoramidite (334 uL, 1.50 mmol) was added and the solution was removed from the ice bath and stirred at room temperature for 2 hours. The product mixture was washed with saturated $NaHCO_3$ (aq.) and extracted with 3% TEA/DCM. The organic layer was dried with $Na_2SO_4$ and concentrated in vacuo. A silica column was neutralized by eluting 3% TEA/DCM 3 times before loading the product residue. The product was purified on silica (50% ethylacetate in 3% TEA/hexanes). 136 (670 mg, 88%) was obtained as a white solid. $^{31}$P NMR (202 MHz, $CD_3CN$) δ 150.68 (s), 151.37 (s).

Synthesis of 2', 3'-O-MOE-hexadecyl Uridine Conjugation

Scheme 22

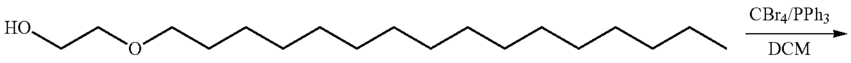

137

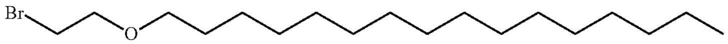

138

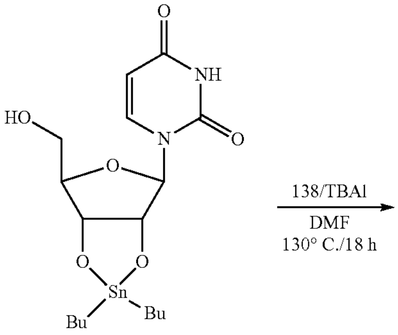

-continued

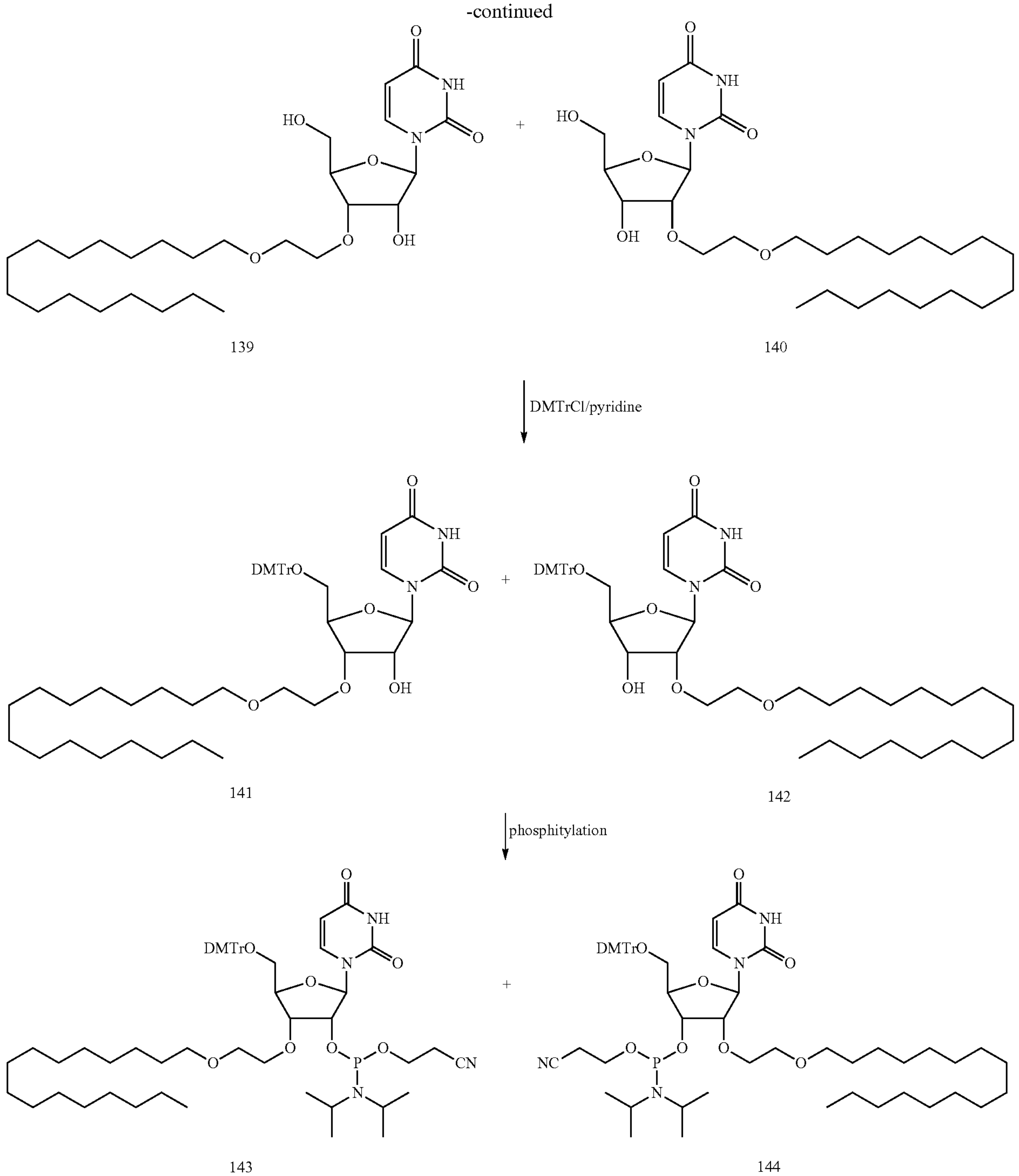

139 140 141 142 143 144

Compound 138: 137 (3 g, 10.47 mmol) was placed under high vac. and back-filled with argon three times. DCM (105 mL) was added, forming a clear solution and placed in an ice bath. Carbon tetrabromide (4.86 g, 14.66 mmol) and triphenylphosphine (3.57 g, 13.61 mmol) was added, forming a brown tinted solution stirred at room temperature for 1 hour. The product was extracted with DCM/water. The organic layer was dried with $Na_2SO_4$ and concentrated in vacuo. The product was purified on silica (100% hexanes) to obtain 138 (3.08 g, 84%) as a clear oil. $^1H$ NMR (400 MHz, $CDCl_3$) δ 3.73 (t, 2H), 3.44-3.50 (m, 4H), 1.55-1.62 (m, 2H), 1.25 (s, 26H), 0.88 (t, 3H).

Compound 139 and 140: To a solution of 2, 3'-O-dibutylstannylene uridine (2.7 g, 5.68 mmol) in DMF (60 mL) was added 1-2(bromoethoxy)hexadecane (4.01 g, 11.48 mmol) and tetrabutylammonium iodide (4.20 g, 11.37 mmol). The mixture was stirred at 130° C. in a reflux set-up overnight, forming a dark brown solution. The solution was eluted on silica (30% MeOH/DCM) and all UV active fractions were collected. The fractions were concentrated in vacuo and the product residue was purified on silica (5% MeOH/DCM) to obtain a crude mixture of 139 and 140 (550 mg).

Compound 141 and 142: Standard dimethoxytritylation of compounds 139 and 140 in pyridine can give compounds 141 and 142.
Compound 143 and 144: Standard phosphitylation of compounds 141 and 142 in $CH_2Cl_2$ can give compounds 143 and 144.
Synthesis of 2', 3'-O-hexadecyl Uridine Phosphoramidites
Scheme 23
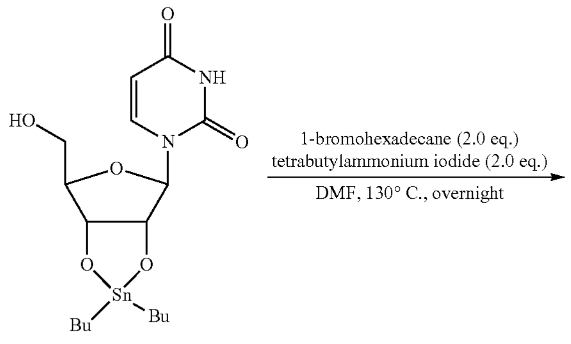
130
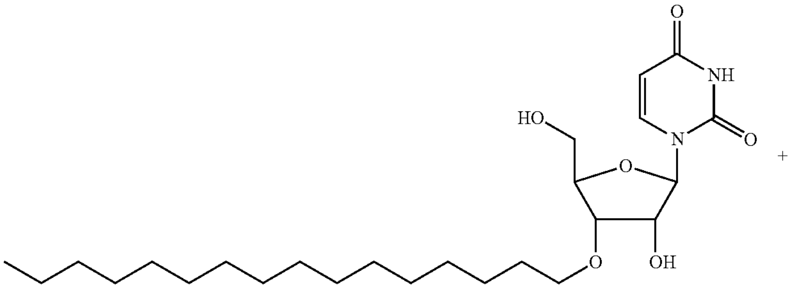
145
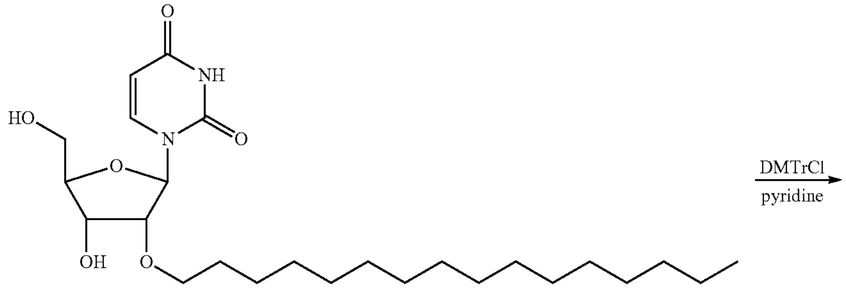
146
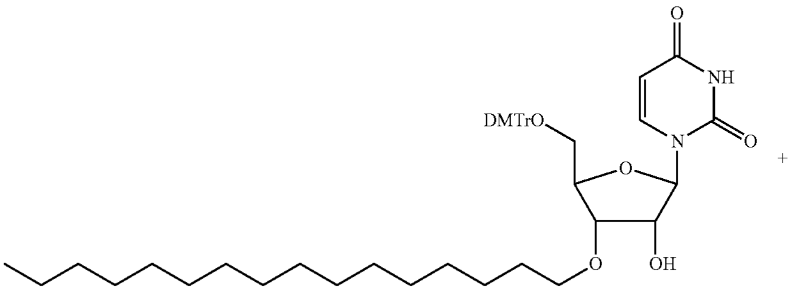
147

-continued
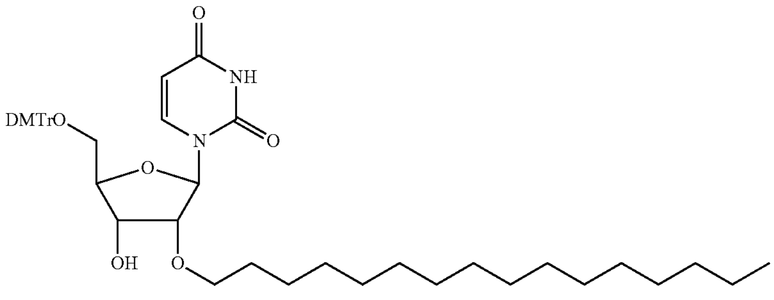
148
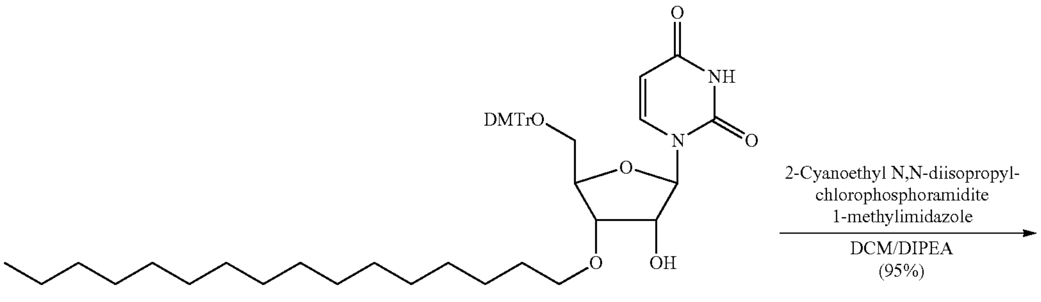
147
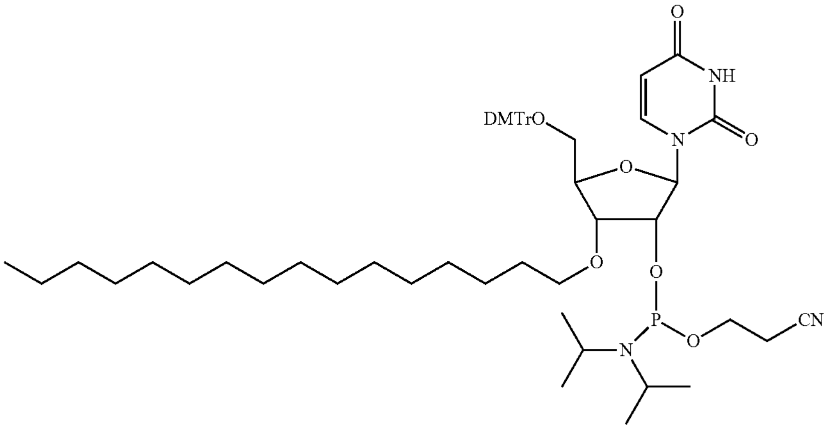
149
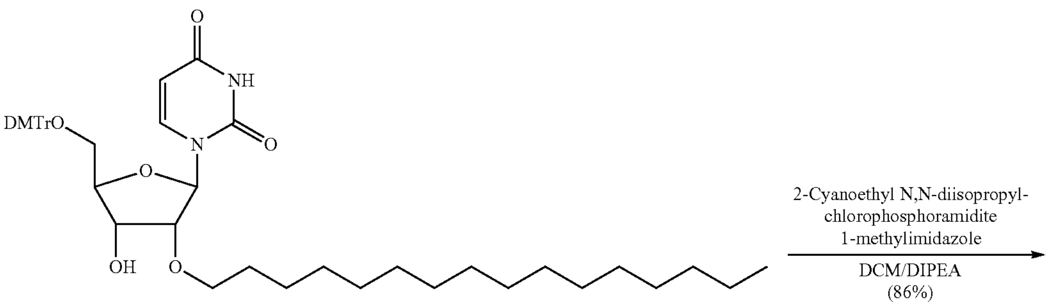
148

-continued

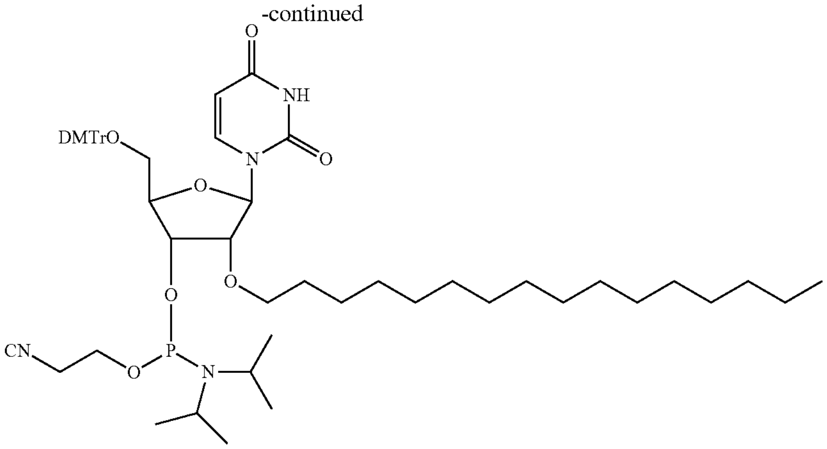

150

Compounds 145 and 146: To a solution of 2, 3'-O-dibutylstannylene uridine 130 (6.6 g, 13.89 mmol) in DMF (150 mL) was added 1-bromohexadecane (8.48 g, 27.78 mmol) and tetrabutylammonium iodide (10.26 g, 27.78 mmol). The mixture was stirred at 130° C. in a reflux set-up overnight, forming a dark brown solution. The solution was eluted on silica (30% MeOH/DCM) and all UV active fractions were collected. The fractions were concentrated in vacuo and the product residue was eluted on silica (5% MeOH/DCM) to obtain a crude mixture of 145 and 146 (3.38 g).

Compound 147 and 148: Pyridine (10 mL) was added to a crude mixture of 145 and 146 (2.34 g, 4.99 mmol) and concentrated in vacuo to remove trace water. The mixture residue was placed under high vac. and back-filled with argon 3 times. A solution of 145 and 146 in pyridine (42 mL) was treated with 4,4'-dimethoxytrityl chloride (1.86 g, 5.49 mmol) and stirred at room temperature overnight under argon. The reaction was quenched with MeOH (5 mL) and concentrated in vacuo. The product residue was dissolved in 3% TEA/DCM and washed with saturated $NaHCO_3$ (aq.) and brine. The organic layer was dried with $Na_2SO_4$ and concentrated in vacuo. A silica column was neutralized by eluting 3% TEA/DCM 3 times before loading the product residue. The product was purified on silica (40-60% ethylacetate in 3% TEA/hexanes). 147 (1.32 g, 34%) and 148 (660 mg, 17%) were separated and obtained as white solids. 147: $^1$H NMR (500 MHz, DMSO-$d_6$) δ 11.3 (brs, 1H), 7.74 (d, 1H), 7.33 (d, 2H), 7.28 (t, 2H), 7.20-7.22 (m, 5H), 6.85-6.87 (m, 4H), 5.66 (d, 1H), 5.38 (d, 1H), 5.30 (d, 1H), 4.19-4.22 (m, 1H), 3.88-3.96 (m, 2H), 3.70 (s, 6H), 3.53-3.57 (m, 1H), 3.34-3.38 (m, 1H), 3.22-3.31 (m, 2H), 1.45-1.48 (m, 2H), 1.21-1.27 (m, 26H), 0.84 (t, 3H). $^{13}$C NMR (126 MHz, DMSO-$d_6$) δ 163.0, 158.1, 150.4, 144.6, 140.4, 135.3, 135.1, 129.7, 127.9, 127.7, 126.8, 113.2, 101.3, 89.4, 85.9, 80.4, 76.7, 72.0, 69.7, 62.3, 55.0, 52.0, 31.3, 29.2, 29.0, 29.0, 29.0, 28.9, 28.7, 25.5, 22.1, 13.9, 7.2.

Compound 149: Pyridine (8 mL) was added to 147 (660 mg, 0.856 mmol) and concentrated in vacuo to remove trace water 3 times. The residue was placed under high vac. and back-filled with argon 3 times. DCM (12 mL) was added to form a solution and placed in an ice bath with stirring. N,N-Diisopropylethylamine (447 uL, 2.57 mmol) and 1-methylimidazole (13.7 uL, 0.171 mmol) was added and stirred for 20 minutes at 0° C. 2-Cyanoethyl N,N-diisopropylchloro-phosphoramidite (382 uL, 1.71 mmol) was added and the solution was removed from the ice bath and stirred at room temperature for 2 hours. The product mixture was washed with saturated $NaHCO_3$ (aq.) and extracted with 3% TEA/DCM. The organic layer was dried with $Na_2SO_4$ and concentrated in vacuo. A silica column was neutralized by eluting 3% TEA/DCM 3 times before loading the product residue. The product was purified on silica (50% ethylacetate in 3% TEA/hexanes). 149 (790 mg, 95%) was obtained as a white solid. $^1$H NMR (500 MHz, $CD_3CN$) δ 8.84 (brs, 1H), 7.77 (d, 0.5H), 7.74 (d, 0.5H), 7.44 (d, 2H), 7.25-7.35 (m, 7H), 6.84-6.94 (m, 4H), 5.91 (d, 0.5H), 5.86 (d, 0.5H), 4.48-4.51 (m, 1H), 4.04-4.12 (m, 2H), 3.80-3.90 (m, 2H), 3.78 (s, 6H), 3.58-3.76 (m, 4H), 3.34-3.36 (m, 1H), 2.59-2.69 (m, 2H), 1.48-1.58 (m, 2H), 1.24-1.31 (m, 28H), 1.18 (d, 9H), 1.15 (d, 3H), 0.89 (t, 3H) $^{31}$P NMR (202 MHz, $CD_3CN$) δ 150.69 (s), 151.38 (s).

Compound 150: Pyridine (6 mL) was added to 148 (1.32 g, 1.71 mmol) and concentrated in vacuo to remove trace water 3 times. The residue was placed under high vac. and back-filled with argon 3 times. DCM (12 mL) was added to form a solution and placed in an ice bath with stirring. N,N-Diisopropylethylamine (894 uL, 5.14 mmol) and 1-methylimidazole (28 uL, 0.342 mmol) was added and stirred for 20 minutes at 0° C. 2-Cyanoethyl N,N-diisopropylchloro-phosphoramidite (765 uL, 3.42 mmol) was added and the solution was removed from the ice bath and stirred at room temperature for 2 hours. The product mixture was washed with saturated $NaHCO_3$ (aq.) and extracted with 3% TEA/DCM. The organic layer was dried with $Na_2SO_4$ and concentrated in vacuo. A silica column was neutralized by eluting 3% TEA/DCM 3 times before loading the product residue. The product was purified on silica (50% ethylacetate in 3% TEA/hexanes). 150 (1.43 g, 86%) was obtained as a white solid. $^1$H NMR (500 MHz, $CD_3CN$) δ 8.92 (brs, 1H), 7.81 (d, 0.6H), 7.72 (d, 0.4H), 7.43-7.47 (m, 2H), 7.23-7.36 (m, 8H), 6.86-6.93 (m, 3H), 5.86 (d, 0.5H), 5.85 (d, 0.6H), 5.18-5.27 (m, 1H), 4.46-4.50 (m, 0.6H), 4.40-4.44 (m, 0.4H), 4.05 (t, 0.6H), 4.02 (t, 0.4H), 3.82-3.93 (m, 1H), 3.77-3.79 (m, 6H), 3.58-3.71 (m, 4H), 3.33-3.39 (m, 1H), 2.64-2.69 (m, 1H), 2.53 (t, 1H), 1.49-1.60 (m, 2H), 1.23-1.37 (m, 28H), 1.17 (dd, 9H), 1.06 (d, 3H), 0.89 (t, 3H)$^{31}$P NMR (202 MHz, $CD_3CN$) δ 150.69 (s), 151.38 (s). $^{31}$P NMR (202 MHz, $CD_3CN$) δ 150.69 (s), 151.06 (s).

Synthesis of 2'-O—C3-amide-C18 Conjugated Uridine Amidite

Scheme 24

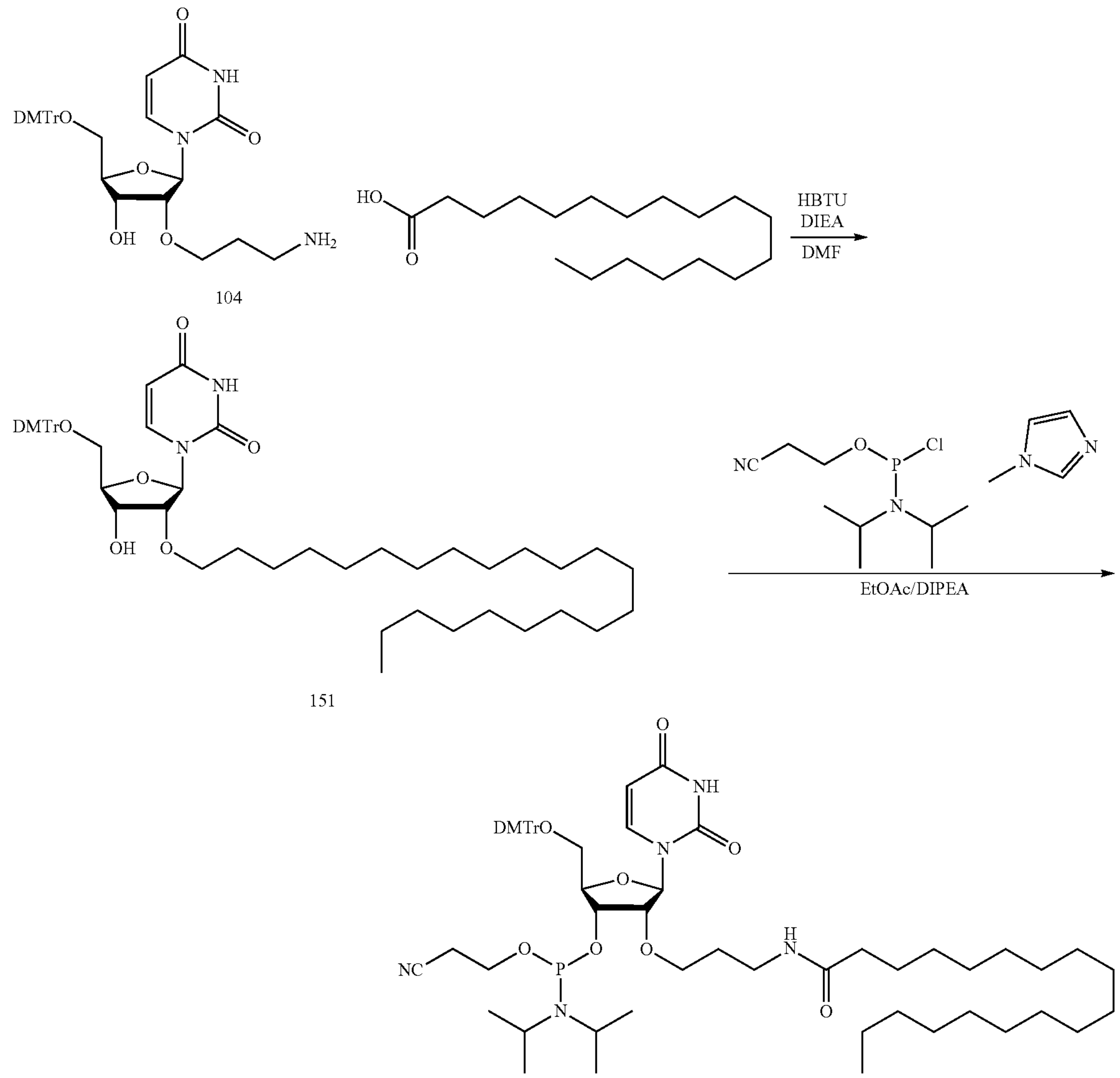

104

151

152

Compound 151: Compound 104 (6.0 g, 9.94 mmol), stearic acid (3.39 g, 11.9 mmol) and HBTU (4.6 g, 12.13 mmol) were combined in an empty flask equipped with a magnetic stirrer bar. The content of the flask was flushed with Argon for 5 min followed by addition of DMF (25 mL) and DIPEA (5.2 mL, 29.8 mmol). After stirring for 20 h, the reaction mixture was diluted with a saturated solution of $NaHCO_3$ and diethyl ether. The layers were separated, and the organic layer was washed with a saturated solution of $NaHCO_3$, brine and dried over $Na_2SO_4$. The volatiles were removed under reduced pressure and the residue was purified by ISCO automated column using 0-6% MeOH in $CH_2Cl_2$ as eluant to give compound 151 (5.5 g, 64%). $^1H$ NMR (500 MHz, Chloroform-d) δ 8.39 (s, 1H), 8.04 (d, J=8.2 Hz, 1H), 7.41-7.36 (m, 2H), 7.32-7.27 (m, 6H), 6.86-6.81 (m, 4H), 5.89 (d, J=1.6 Hz, 1H), 5.81 (t, J=6.3 Hz, 1H), 5.26 (dd, J=8.1, 1.9 Hz, 1H), 4.51-4.42 (m, 1H), 4.08 (dt, J=7.9, 2.4 Hz, 1H), 3.91 (ddd, J=10.3, 6.1, 4.7 Hz, 1H), 3.86 (dd, J=5.2, 1.7 Hz, 1H), 3.80 (d, J=1.3 Hz, 6H), 3.72-3.64 (m, 2H), 3.62 (d, J=8.2 Hz, 1H), 3.55 (d, J=2.4 Hz, 2H), 3.26-3.17 (m, 1H), 2.21-2.13 (m, 2H), 1.91-1.70 (m, 2H), 1.67-1.59 (m, 2H), 1.31-1.21 (m, 28H), 0.88 (t, J=6.9 Hz, 3H).

Compound 152: Compound 151 (5.5 g, 6.32 mmol) was co-evaporated with acetonitrile (×2) and connected to the high vacuum line for 2 h. The residue was dissolved in ethyl acetate (125 mL) and cooled to 0° C. To the previous solution, DIPEA (2.75 mL, 15.80 mmol), 2-cyanoethyl-N,N-diisopropylchlorophosphoramidite (3.53 mL, 15.80 mmol), and 1-methylimidazole (0.50 mL, 6.3 mmol) were added sequentially. The cold bath was removed, and the reaction stirred for 30 min. The reaction was quenched with a solution of triethanolamine (2.7 M, 17.5 mL) in MeCN/toluene and stirred for 5 min. The mixture was diluted with ethyl acetate, transferred to a separatory funnel, layers separated, and the organic layer was washed sequentially with a 5% NaCl solution (50 mL), and brine.

The organic layer was dried over $Na_2SO_4$ and evaporated to dryness. The residue was pre-adsorbed on triethylamine pre-treated silica gel. The column was equilibrated with hexanes containing 1% $NEt_3$. the residue was purified by ISCO automated column using 0-60% EtOAc in hexanes as eluant to give compound 152 (4.5 g, 67%). $^1$H NMR (500 MHz, Acetonitrile-d3) δ 8.95 (s, 1H), 7.77 (dd, J=48.2, 8.1 Hz, 1H), 7.46-7.40 (m, 2H), 7.35-7.27 (m, 6H), 6.90-6.84 (m, 4H), 6.39 (d, J=5.4 Hz, 1H), 5.84 (dd, J=7.6, 2.9 Hz, 1H), 5.20 (t, J=8.4 Hz, 1H), 4.45 (dddd, J=41.9, 10.0, 6.9, 5.0 Hz, 1H), 4.18-4.11 (m, 1H), 4.04-3.99 (m, 1H), 3.76 (d, J=3.1 Hz, 6H), 3.74-3.65 (m, 4H), 3.65-3.54 (m, 3H), 3.53-3.35 (m, 3H), 3.25-3.16 (m, 3H), 2.74 (t, J=5.9 Hz, 1H), 2.67 (td, J=5.9, 2.1 Hz, 1H), 2.54-2.50 (m, 2H), 2.08-2.02 (m, 2H), 1.70 (h, J=6.2 Hz, 2H), 1.54-1.47 (m, 2H), 1.29-1.22 (m, 28H), 1.18-1.01 (m, 12H), 0.87 (t, J=6.8 Hz, 3H). $^{31}$P NMR (202 MHz, $CD_3CN$) δ 149.59, 149.15.

Synthesis of 2'-O—C3-amide-C14 Conjugated Uridine Amidite

Scheme 24

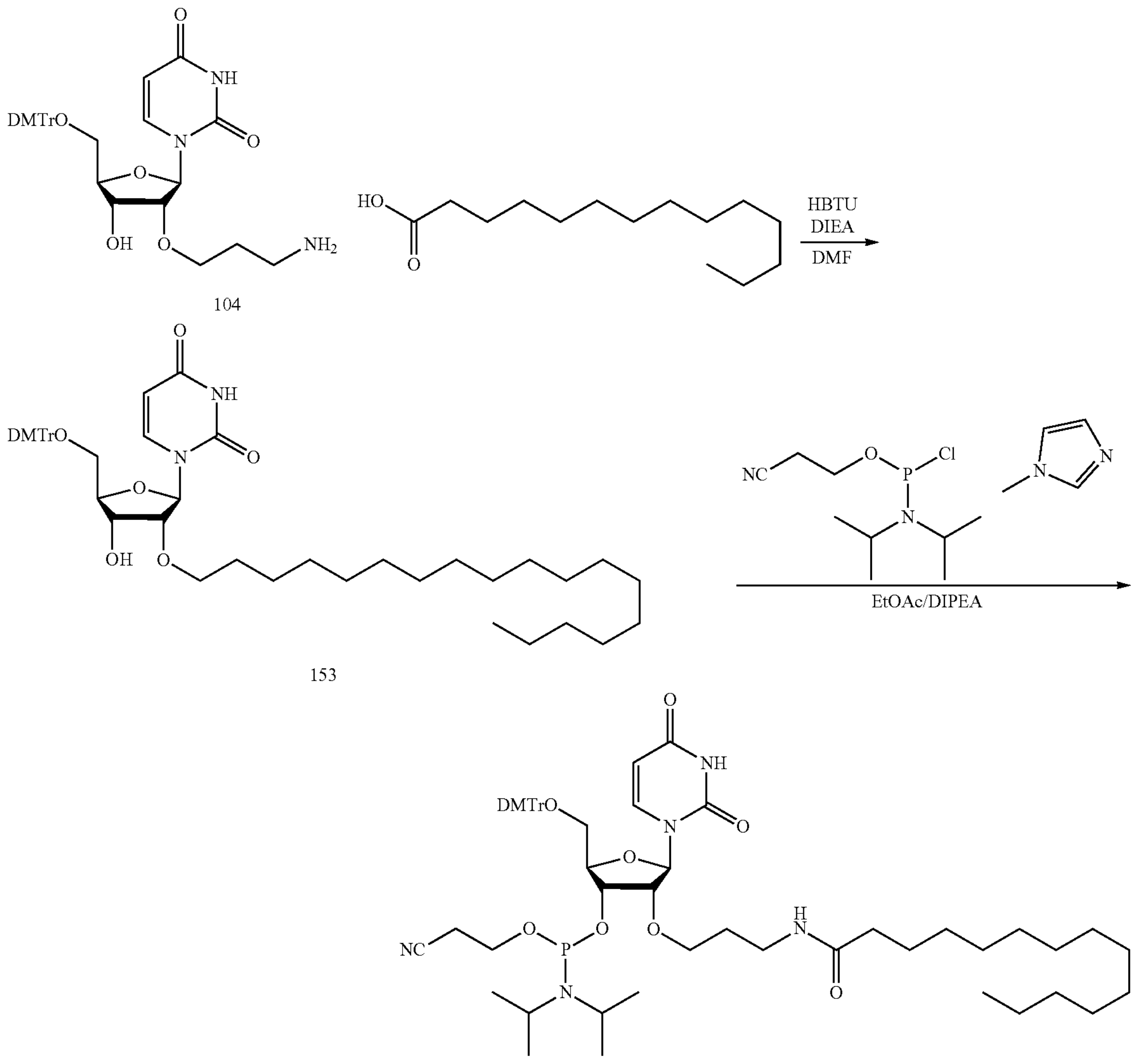

104

153

154

Compound 153: Compound 104 (5.0 g, 8.3 mmol), tetradecanoic acid (2.10 g, 9.19 mmol) and HBTU (3.83 g, 10.1 mmol) were combined in an empty flask equipped with a magnetic stirrer bar. The content of the flask was flushed with Argon for 5 min followed by addition of DMF (25 mL) and DIPEA (4.3 mL, 24.8 mmol). After stirring for 20 h, the reaction mixture was diluted with a saturated solution of $NaHCO_3$ and diethyl ether. The layers were separated, and the organic layer was washed with a saturated solution of $NaHCO_3$, brine and dried over $Na_2SO_4$. The volatiles were removed under reduced pressure and the residue was purified by ISCO automated column. using 0-6% MeOH in $CH_2Cl_2$ as eluant to give compound 153 (3.93 g, 58%). $^1$H NMR (400 MHz, Chloroform-d) δ 8.94 (s, 1H), 7.44-7.23 (m, 9H), 6.91-6.78 (m, 4H), 5.95-5.85 (m, 2H), 5.32-5.22

(m, 1H), 4.46 (q, J=6.6 Hz, 1H), 4.08 (dt, J=8.0, 2.4 Hz, 1H), 3.98-3.89 (m, 1H), 3.86 (dd, J=5.2, 1.6 Hz, 1H), 3.80 (d, J=1.0 Hz, 6H), 3.72-3.52 (m, 4H), 2.20-2.13 (m, 2H), 1.89-1.53 (m, 5H), 1.31-1.19 (m, 20H), 0.87 (t, J=6.7 Hz, 3H).

Compound 154: Compound 153 (3.93 g, 4.83 mmol) was co-evaporated with acetonitrile (×2) and connected to the high vacuum line for 2 h. The residue was dissolved in ethyl acetate (100 mL) and cooled to 0° C. To the previous solution, DIPEA (2.1 mL, 12.1 mmol), 2-cyanoethyl-N,N-diisopropylchlorophosphoramidite (2.69 mL, 12.1 mmol), and 1-methylimidazole (0.38 mL, 4.83 mmol) were added sequentially. The cold bath was removed, and the reaction stirred for 30 min. The reaction was quenched with a solution of triethanolamine (2.7 M, 14 mL) in MeCN/toluene and stirred for 5 min. The mixture was diluted with ethyl acetate, transferred to a separatory funnel, layers separated, and the organic layer was washed sequentially with a 5% NaCl solution (50 mL), and brine. The organic layer was dried over $Na_2SO_4$ and evaporated to dryness. The residue was pre-adsorbed on triethylamine pre-treated silica gel. The column was equilibrated with hexanes containing 1% $NEt_3$. The residue was purified by ISCO automated column using 0-60% EtOAc in hexanes as eluant to give compound 154 (4.38 g, 89%). $^1H$ NMR (500 MHz, Chloroform-d) δ 8.03 (dd, J=29.4, 8.2 Hz, 1H), 7.44-7.35 (m, 2H), 7.34-7.21 (m, 10H), 6.84 (ddd, J=8.9, 7.1, 3.1 Hz, 4H), 6.20 (q, J=6.3 Hz, 1H), 5.91 (dd, J=7.1, 2.0 Hz, 1H), 5.23 (dd, J=19.9, 8.1 Hz, 1H), 4.66-4.43 (m, 1H), 4.26-4.18 (m, 1H), 4.01 (ddd, J=11.6, 4.9, 2.0 Hz, 1H), 3.94-3.67 (m, 11H), 3.67-3.39 (m, 7H), 3.32 (tq, J=13.0, 6.1 Hz, 1H), 2.68-2.56 (m, 2H), 2.49-2.39 (m, 1H), 2.13 (q, J=7.9 Hz, 2H), 1.86-1.76 (m, 2H), 1.59 (s, 5H), 1.28-1.22 (m, 21H), 1.21-1.12 (m, 10H), 1.04 (d, J=6.8 Hz, 3H), 0.88 (t, J=6.9 Hz, 3H). $^{31}P$ NMR (202 MHz, $CDCl_3$) δ 150.21, 149.86.

Synthesis of 5'-amide-lipophilic Conjugated 2'-OMe-Cytidine Amidite

Scheme 26

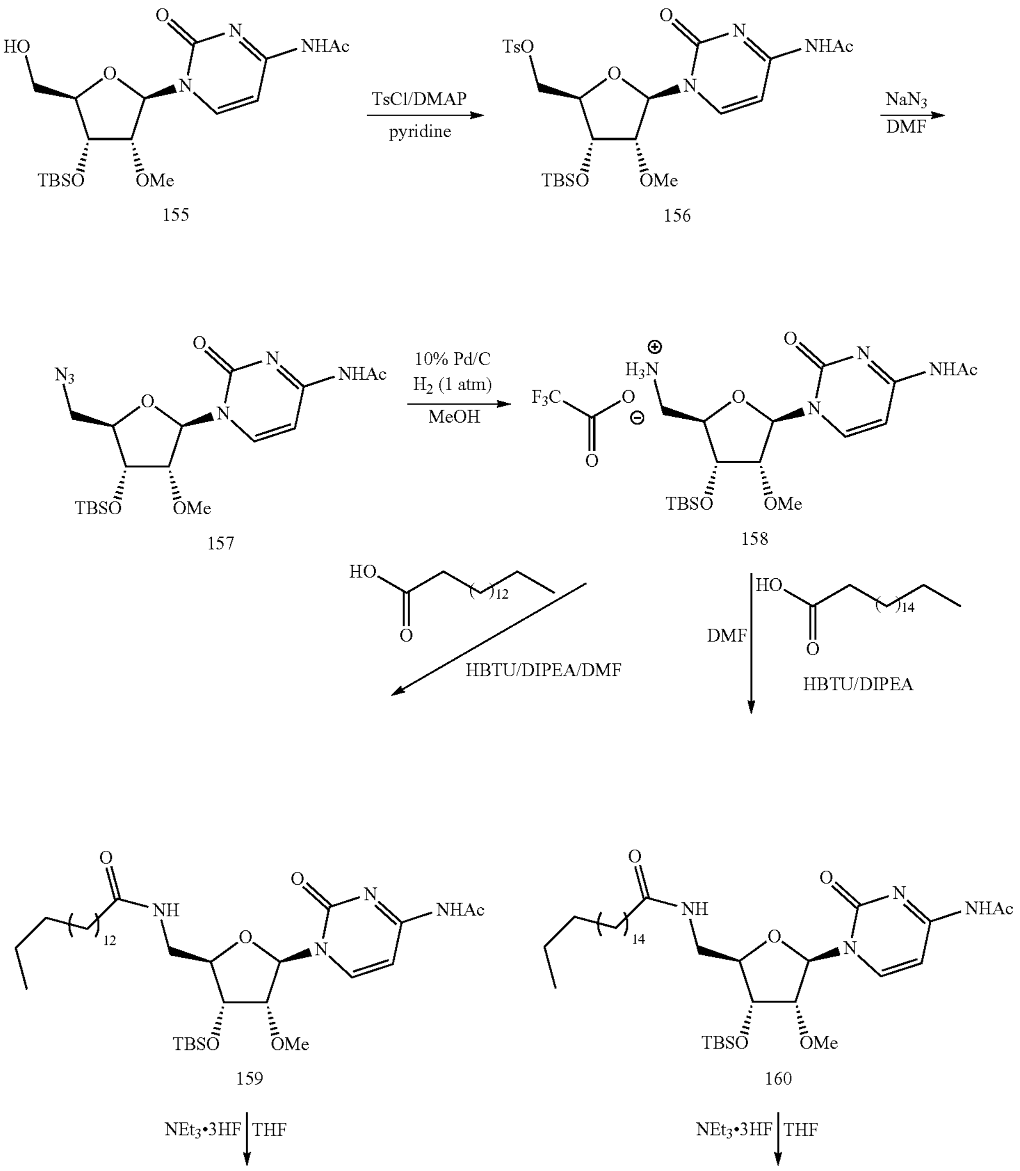

155 156 157 158 159 160

-continued

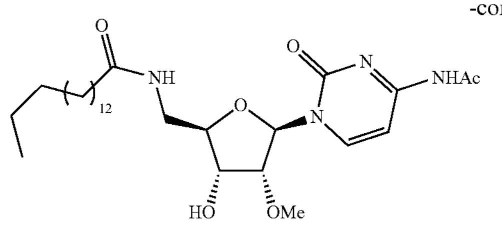

161

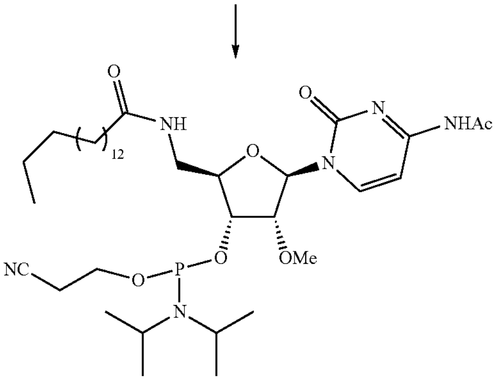

163

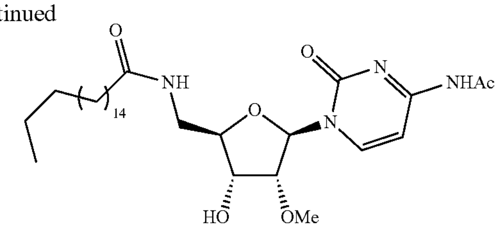

162

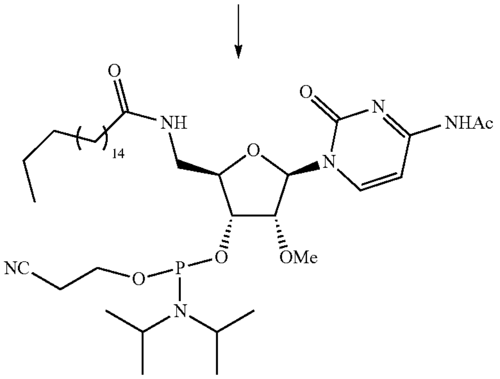

164

Compound 156: p-toluenesulfonyl chloride (20.7 g, 0.108 mol) was added to a stirred solution of compound 155 (30.0 g, 72.5 mmol) and pyridine (29.3 mL, 0.363 mmol) in anhydrous $CH_2Cl_2$ (220 mL). The reaction mixture was heated to reflux for 48 h. After cooling down, $CH_2Cl_2$ (200 mL) and a saturated aqueous solution of $NaHCO_3$ (500 mL) was added slowly and stirred vigorously for 1 h. The mixture was transferred to a separatory funnel, the layers were separated, and organic layer was washed with 1M HCl, and brine. The organic layer was dried over $Na_2SO_4$, filtered and evaporated to dryness to give crude tosylate 156 (41.2 g). Crude tosylate was used in the next reaction without further purification.

Compound 157: Sodium azide (14.15 g, 0.217 mol) was added to a stirred solution of compound 156 (41.2 g, 72.6 mmol) in DMF (360 mL). The resulting mixture was heated at 90° C. for 8 h, cooled to room temperature, and combined with water (300 mL) and diethyl ether (200 mL). The mixture was transferred to a separatory funnel, the layers were separated, and the aqueous layer was extracted twice with diethyl ether. The organic layers were combined, and dried over $Na_2SO_4$, evaporated to dryness. The residue was purified by ISCO automated column using 0-60% EtOAc in hexanes as eluant to give compound 157 (27.5 g, 86% over two steps). $^1H$ NMR (500 MHz, Chloroform-d) δ 9.06 (s, 1H), 8.24 (d, J=7.5 Hz, 1H), 7.46 (d, J=7.5 Hz, 1H), 5.89 (s, 1H), 4.17 (dt, J=8.9, 2.8 Hz, 1H), 4.01 (dd, J=8.9, 4.8 Hz, 1H), 3.94 (dd, J=13.5, 2.8 Hz, 1H), 3.69-3.60 (m, 6H), 2.26 (s, 3H), 0.90 (s, 9H), 0.08 (s, 6H).

Compound 158: To a stirred solution of compound 157 (17.0 g, 38.8 mmol) in methanol (300 mL), 10% Pd/C Degussa type (4.13 g, 3.88 mmol) was added. The flask was equipped with a 3-way adapter connected to a balloon filled with Hydrogen, and to the vacuum line. The content of the flask was subjected to a sequence of vacuum/refill with Hydrogen (x3). After 40 min, TFA (3 ml) was added, the resulting mixture was filtered through a celite pad and the volatiles evaporated to dryness. The residue was purified by ISCO automated column using 0-10% of MeOH in $CH_2Cl_2$ as eluent to give compound 158 (12.5 g, 77%). $^1H$ NMR (400 MHz, DMSO-d6) δ 10.98 (s, 1H), 8.15 (d, J=7.5 Hz, 1H), 8.03 (s, 3H), 7.25 (d, J=7.5 Hz, 1H), 5.87 (d, J=3.3 Hz, 1H), 4.21 (t, J=5.7 Hz, 1H), 4.12-4.06 (m, 1H), 4.03-3.93 (m, 1H), 3.40 (s, 3H), 3.30-3.17 (m, 1H), 3.15-3.03 (m, 1H), 2.11 (s, 3H), 0.88 (s, 9H), 0.09 (d, J=2.0 Hz, 6H). $^{19}F$ NMR (376 MHz, DMSO) δ −73.75.

Compound 159: Compound 158 (5.1 g, 9.7 mmol), palmitic acid (2.74 g, 10.7 mmol) and HBTU (4.41 g, 11.6 mmol) were combined in an empty flask equipped with a magnetic stirrer bar. The content of the flask was flushed with Argon for 5 min followed by addition of DMF (32 mL) and DIPEA (6.76 mL, 38.8 mmol). After stirring for 4 h, the reaction mixture was diluted with a saturated solution of $NaHCO_3$ and diethyl ether. The layers were separated, and the organic layer was washed with a saturated solution of $NaHCO_3$, brine and dried over $Na_2SO_4$. The volatiles were removed under reduced pressure and the residue was purified by ISCO automated column using 0-6% MeOH in $CH_2Cl_2$ as eluent to give compound 159. (4.97 g, 78%). $^1H$ NMR (400 MHz, Chloroform-d) δ 8.64 (s, 1H), 7.78 (d, J=7.4 Hz, 1H), 7.46 (d, J=7.4 Hz, 1H), 5.47 (d, J=3.9 Hz, 1H), 4.23-4.19 (m, 1H), 4.18-4.09 (m, 2H), 3.84-3.75 (m, 1H), 3.46 (s, 3H), 3.44-3.36 (m, 1H), 2.28-2.20 (m, 5H), 1.64-1.59 (m, 2H), 1.31-1.23 (m, 24H), 0.94-0.86 (m, 12H), 0.09 (s, 6H).

Compound 160: Compound 158 (5.85 g, 11.1 mmol), stearic acid (3.47 g, 12.2 mmol) and HBTU (5.05 g, 13.3 mmol) were combined in an empty flask equipped with a magnetic stirrer bar. The content of the flask was flushed with Argon for 5 min followed by addition of DMF (37 mL) and DIPEA (7.74 mL, 44.4 mmol). After stirring for 4 h, the reaction mixture was diluted with a saturated solution of $NaHCO_3$ and diethyl ether. The layers were separated, and the organic layer was washed with a saturated solution of $NaHCO_3$, brine and dried over $Na_2SO_4$. The volatiles were removed under reduced pressure and the residue was purified by ISCO automated column using 0-6% MeOH in $CH_2Cl_2$ as eluent to give compound 160. (3.87 g, 51%). $^1H$ NMR (400 MHz, Chloroform-d) δ 8.44 (s, 1H), 7.77 (d, J=7.5 Hz, 1H), 7.45 (d, J=7.4 Hz, 1H), 5.46 (d, J=3.9 Hz, 1H), 4.24-4.19 (m, 1H), 4.17-4.10 (m, 2H), 3.46 (s, 3H), 3.41-3.36 (m, 1H), 2.27-2.24 (m, 2H), 1.29-1.23 (m, 28H), 0.92-0.86 (m, 12H), 0.10-0.08 (m, 6H).

Compound 161: Triethylamine trihydrofluoride (3.5 mL, 21.7 mmol) was added to a stirred solution of compound 159 (4.7 g, 7.2 mmol) in THF (50 mL) at 0° C. After stirring for 24 h at r.t, the volatiles were removed under reduced pressure and the residue was purified by ISCO automated column using 0-6% MeOH in $CH_2Cl_2$ as eluent to give compound 161 (3.49 g, 90%). $^1H$ NMR (400 MHz, DMSO-d6) δ 10.94 (s, 1H), 8.12 (d, J=7.5 Hz, 1H), 8.01 (t, J=5.9 Hz, 1H), 7.24 (d, J=7.5 Hz, 1H), 5.82 (d, J=3.3 Hz, 1H), 5.19 (d, J=5.7 Hz, 1H), 3.93-3.84 (m, 2H), 3.78 (t, J=3.9 Hz, 1H), 3.42 (s, 3H), 2.13-2.05 (m, 5H), 1.48 (s, 2H), 1.34-1.16 (m, 25H), 0.86 (t, J=6.6 Hz, 3H).

Compound 162: Triethylamine trihydrofluoride (2.66 mL, 16.5 mmol) was added to a stirred solution of compound 160 (3.74 g, 5.51 mmol) in THF (50 mL) at 0° C. After stirring for 24 h at r.t, the volatiles were removed under reduced pressure and the residue was purified by ISCO automated column using 0-6% MeOH in $CH_2Cl_2$ as eluent to give compound 162.

Compound 163/164: Standard phosphitylation of compounds 161 and 162 gives compounds 163 and 164, respectively.

Synthesis of 5'-amide-lipophilic Conjugated 2'-OMe-adenosine Amidite

Scheme 27

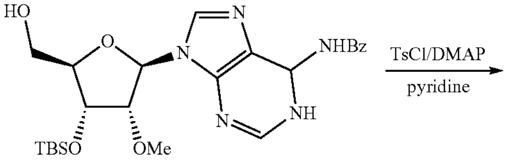

165

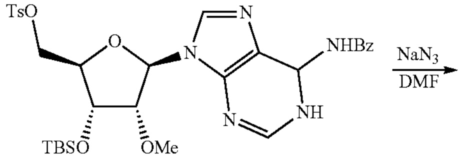

166

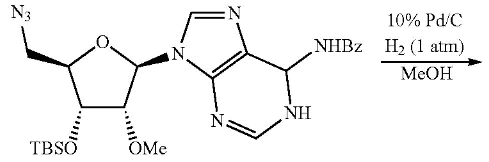

167

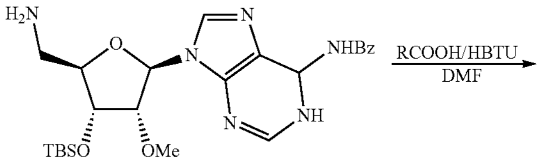

168

-continued

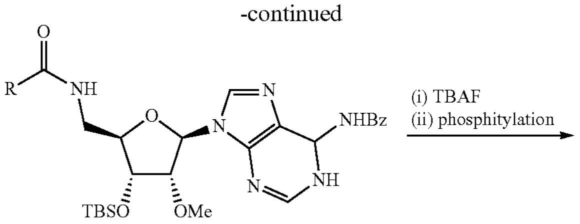

169

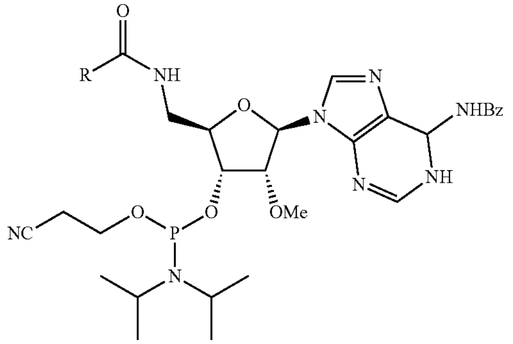

170

RCOOH:
(a) Decanoic acid (C10)
(b) Lauric acid (C12)
(c) Myristic acid (C14)
(d) Palmitic acid (C16)
(e) Stearic acid (C18)
(f) Docosanoic acid (C22)
(g) Oleic acid
(h) Linoleic acid
(i) Docosahexaenoic acid or R =

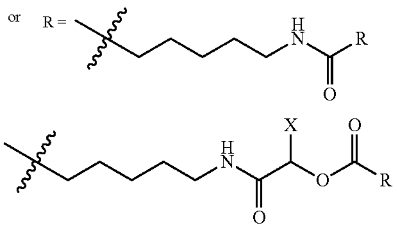

X = Me, Et, iPr, alkyl

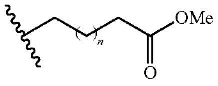

n = 12, 14, 16

Compound 166: p-toluenesulfonyl chloride (34.3 g, 0.180 mmol) was added to a stirred solution of compound 165 (30.0 g, 60.0 mmol) and pyridine (24.3 mL, 300 mmol) in anhydrous $CH_2Cl_2$ (180 mL). The reaction mixture was heated to reflux for 48 h. After cooling down, $CH_2Cl_2$ (200 mL) and a saturated aqueous solution of $NaHCO_3$ (500 mL) was added slowly and stirred vigorously for 1 h. The mixture was transferred to a separatory funnel, the layers were separated, and organic layer was washed with 1M HCl, and brine. The organic layer was dried over $Na_2SO_4$, filtered and evaporated to dryness to give crude tosylate 166. Crude tosylate was used in the next reaction without further purification.

Compound 167: Sodium azide (11.93 g, 183.5 mmol) was added to a stirred solution of crude compound 166 (40.0 g, 61.2 mmol) in DMF (300 mL). The resulting mixture was heated at 90° C. for 8 h, cooled to room temperature, and combined with water (300 mL) and diethyl ether (200 mL). The mixture was transferred to a separatory funnel, the layers separated, and the aqueous layer was extracted twice with diethyl ether. The organic layers were combined, and dried over $Na_2SO_4$, evaporated to dryness. The residue was purified by ISCO automated column using 0-8% MeOH in $CH_2Cl_2$ as eluent to give compound 167 (29.8 g, 92%). $^1H$ NMR (500 MHz, Chloroform-d, mixture of rotamers) δ 8.97 (s, 1H), 8.83-8.78 (m, 1H), 8.32-8.28 (m, 1H), 8.06-8.00 (m, 2H), 7.65-7.60 (m, 1H), 7.53 (dd, J=8.4, 7.0 Hz, 2H), 6.13 (d, J=3.4 Hz, 1H), 4.57-4.50 (m, 1H), 4.38 (dd, J=4.9, 3.5 Hz, 1H), 4.21 (dt, J=6.0, 4.0 Hz, 1H), 3.78 (dd, J=13.4, 3.9 Hz, 1H), 3.61 (dd, J=13.3, 4.3 Hz, 1H), 3.55-3.49 (m, 3H), 0.98-0.90 (m, 9H), 0.20-0.09 (m, 6H).

Compound 168: To a stirred solution of compound 167 (13.58 g, 25.88 mmol) in methanol (130 mL), 10% Pd/C Degussa type (2.75 g, 2.59 mmol) was added. The flask was equipped with a 3-way adapter connected to a balloon filled with Hydrogen, and to the vacuum line. The content of the flask was subjected to a sequence of vacuum/refill with Hydrogen (x3). After 40 min, the reaction mixture was filtered through a celite pad and the volatiles evaporated to dryness. The residue was purified by ISCO automated column using 0-10% of MeOH in $CH_2Cl_2$ as eluent to give compound 168 (9.4 g, 72%). $^1H$ NMR (500 MHz, Chloroform-d) δ 8.99 (s, 1H), 8.79 (s, 1H), 8.28 (s, 1H), 8.03 (d, J=7.2 Hz, 2H), 7.65-7.59 (m, 1H), 7.57-7.50 (m, 2H), 6.07 (d, J=4.6 Hz, 1H), 4.56-4.45 (m, 2H), 4.15-4.08 (m, 1H), 3.43 (s, 3H), 3.14 (dd, J=13.6, 3.5 Hz, 1H), 2.96 (dd, J=13.6, 5.2 Hz, 1H), 0.95 (s, 9H), 0.14 (d, J=4.0 Hz, 6H). Standard amide coupling of 168 and lipid acids shown as RCOOH gives a variety of 5'-lipophilic conjugates of 2'-OMe-adenosine and these compounds can be converted to the phosphoramidite building blocks as shown in scheme 27 above.

Synthesis of 5'-Amino Adenosine Lipid Amidites

Compound 511: Compound 501 (1.26 g, 5.5 mmol) and HOBT hydrate (1.27 g, 8.3 mmol) were dissolved in anhydrous DMF (30 mL) and THF (10 ml) under an argon atmosphere and cooled to 0-5° C. in a water/ice bath. HBTU (2.45 g, 6.5 mmol) and N,N-diisopropylethylamine (3.0 mL, 17.1 mmol) were added and the solution stirred for 10 minutes. Compound 500 (2.3 g, 4.6 mmol) was added and the reaction was stirred at 0-5° C. for 2 h. Reaction diluted with ethyl acetate (50 ml) and 5% NaCl (200 mL). Stirred 5 minutes and isolated the organic layer. Organic layer washed with 10% $H_3PO_4$ (1×200 mL), 5% NaCl (1×200 mL), 4% $NaHCO_3$ (1×200 mL), and saturated NaCl (1×200 mL). Organic layer dried over $Na_2SO_4$, filtered, and concentrated under reduced pressure at 25° C. to a foam. Purification by silica gel flash chromatography, 80 g silica column, ethyl acetate:hexanes (1:1 to 10:1 gradient). Concentrated fractions under reduced pressure and chased with acetonitrile (2×). Dried under high vacuum overnight. Compound 511 was isolated as a white foam, 87% yield (2.86 g). $^1H$ NMR (400 MHz, DMSO-$d_6$) δ 11.23 (s, 1H), 8.77 (d, J=8.6 Hz, 2H), 8.13-7.96 (m, 3H), 7.64 (t, J=7.4 Hz, 1H), 7.54 (t, J=7.6 Hz, 2H), 6.11 (d, J=6.9 Hz, 1H), 4.72 (dd, J=6.9, 4.5 Hz, 1H), 4.54 (dd, J=4.6, 2.2 Hz, 1H), 4.01-3.88 (m, 1H), 3.55-3.42 (m, 1H), 3.39-3.29 (m, 1H), 3.27 (s, 3H), 2.08 (t, J=7.4 Hz, 2H), 1.48 (t, J=7.1 Hz, 2H), 1.20 (s, 20H), 0.91 (s, 9H), 0.83 (t, J=6.7 Hz, 3H), 0.12 (s, 6H). $^{13}C$ NMR (101 MHz, DMSO-$d_6$) δ 172.42, 165.57, 152.12, 151.68, Scheme 28

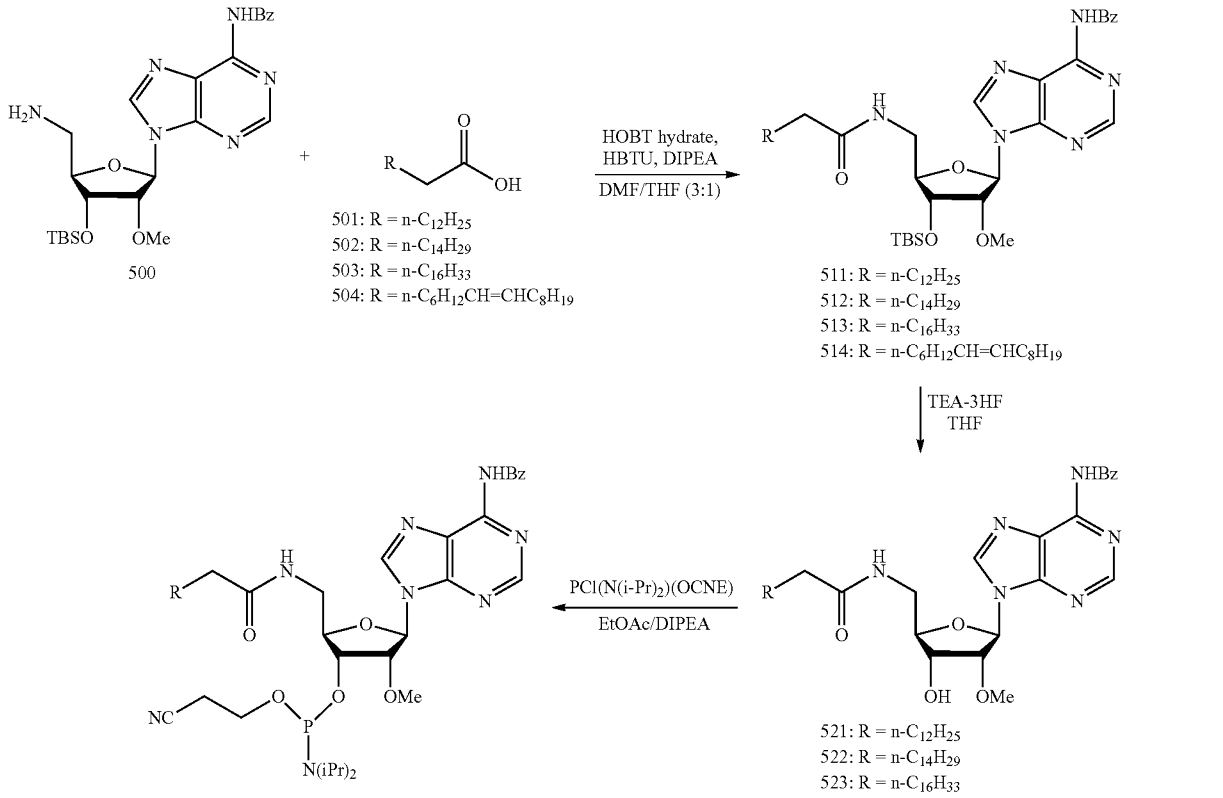

500

501: R = n-$C_{12}H_{25}$
502: R = n-$C_{14}H_{29}$
503: R = n-$C_{16}H_{33}$
504: R = n-$C_6H_{12}CH{=}CHC_8H_{19}$

511: R = n-$C_{12}H_{25}$
512: R = n-$C_{14}H_{29}$
513: R = n-$C_{16}H_{33}$
514: R = n-$C_6H_{12}CH{=}CHC_8H_{19}$

521: R = n-$C_{12}H_{25}$
522: R = n-$C_{14}H_{29}$
523: R = n-$C_{16}H_{33}$
524: R = n-$C_6H_{12}CH{=}CHC_8H_{19}$

531: R = n-$C_{12}H_{25}$
532: R = n-$C_{14}H_{29}$
533: R = n-$C_{16}H_{33}$
534: R = n-$C_6H_{12}CH{=}CHC_8H_{19}$ 150.58, 143.79, 132.43, 128.47, 128.41, 85.37, 84.69, 80.66, 70.96, 57.50, 40.54, 35.31, 31.28, 29.03, 29.00, 28.98, 28.87, 28.79, 28.70, 28.68, 25.60, 25.11, 22.08, 17.79, 13.90, −4.89.

Compound 512: Compound 512 was synthesized from compound 500 and 502 in an analogous fashion to compound 511. Compound 512 was isolated as a glassy solid, 90% yield (3.05 g). $^1$H NMR (400 MHz, DMSO-$d_6$) δ 11.23 (s, 1H), 8.77 (d, J=8.8 Hz, 2H), 8.05 (d, J=7.5 Hz, 3H), 7.64 (t, J=7.4 Hz, 1H), 7.54 (t, J=7.6 Hz, 2H), 6.11 (d, J=6.9 Hz, 1H), 4.72 (dd, J=7.0, 4.5 Hz, 1H), 4.53 (dd, J=4.5, 2.2 Hz, 1H), 3.99-3.92 (m, 1H), 3.55-3.42 (m, 1H), 3.36-3.27 (m, 1H), 3.26 (s, 3H) 2.08 (t, J=7.4 Hz, 2H), 1.53-1.41 (m, 2H), 1.30-1.15 (m, 24H), 0.91 (s, 9H), 0.87-0.78 (m, 3H), 0.12 (s, 6H). $^{13}$C NMR (101 MHz, DMSO-$d_6$) δ 172.41, 152.11, 151.68, 150.58, 143.79, 132.43, 128.47, 128.42, 126.05, 85.37, 84.70, 80.66, 70.96, 57.50, 40.54, 35.30, 31.27, 29.03, 29.01, 28.99, 28.96, 28.86, 28.78, 28.69, 28.67, 25.60, 25.11, 22.07, 17.79, 13.90, −4.89.

Compound 513: Compound 513 was synthesized from compound 500 and 503 in an analogous fashion to compound 511. Compound 513 was isolated in 87% yield (3.05 g). $^1$H NMR (400 MHz, DMSO-$d_6$) δ 11.24 (s, 1H), 8.77 (d, J=11.1 Hz, 2H), 8.09-7.99 (m, 3H), 7.67-7.59 (m, 1H), 7.59-7.49 (m, 2H), 6.11 (d, J=6.9 Hz, 1H), 4.73 (dd, J=7.0, 4.5 Hz, 1H), 4.53 (dd, J=4.5, 2.1 Hz, 1H), 3.99-3.91 (m, 1H), 3.55-3.43 (m, 1H), 3.38-3.22 (m, 4H), 2.08 (t, J=7.4 Hz, 2H), 1.54-1.42 (m, 2H), 1.30-1.12 (m, 28H), 0.91 (s, 9H), 0.86-0.78 (m, 3H), 0.11 (s, 6H). $^{13}$C NMR (101 MHz, DMSO-$d_6$) δ 172.40, 165.57, 151.68, 150.59, 143.80, 133.26, 132.44, 128.48, 128.42, 85.37, 84.71, 80.64, 70.96, 57.50, 40.54, 35.31, 31.30, 29.04, 29.01, 28.99, 28.89, 28.81, 28.72, 25.60, 25.12, 22.09, 17.79, 13.90, −4.89, −4.91.

Compound 514: Compound 514 was synthesized from compound 500 and 504 in an analogous fashion to compound 511. Compound 514 was isolated as a white foam, 77% yield (2.08 g). $^1$H NMR (400 MHz, DMSO-$d_6$) δ 11.23 (s, 1H), 8.77 (d, J=9.7 Hz, 2H), 8.05 (d, J=7.4 Hz, 3H), 7.64 (t, J=7.3 Hz, 1H), 7.54 (t, J=7.6 Hz, 2H), 6.11 (d, J=6.9 Hz, 1H), 5.35-5.22 (m, 2H), 4.73 (dd, J=7.0, 4.5 Hz, 1H), 4.54 (dd, J=4.6, 2.1 Hz, 1H), 4.00-3.90 (m, 1H), 3.55-3.42 (m, 1H), 3.39-3.20 (m, 4H), 2.08 (t, J=7.4 Hz, 2H), 2.01-1.85 (m, 4H), 1.55-1.41 (m, 2H), 1.41-1.09 (m, 20H), 0.91 (s, 9H), 0.87-0.77 (m, 3H), 0.12 (s, 6H). $^{13}$C NMR (101 MHz, DMSO-$d_6$) δ 172.37, 165.56, 152.10, 151.66, 143.77, 132.41, 129.54, 129.52, 128.46, 128.40, 126.04, 85.37, 84.69, 80.64, 70.96, 57.49, 40.54, 35.29, 31.25, 29.06, 28.80, 28.69, 28.66, 28.56, 28.47, 26.57, 26.53, 25.58, 25.11, 22.06, 17.78, 13.87, −4.91.

Compound 521: Compound 511 (2.99 g, 3.9 mmol) was dissolved in anhydrous THF (12 mL) under an argon atmosphere. Triethylamine trihydrofluoride (2.6 mL, 15.7 mmol) was added and the reaction was stirred at rt for 19 h, then heated to 45° C. for 3 h. The reaction was cooled to rt and concentrated to an oil under reduced pressure. The oil was diluted with ethyl acetate (50 mL) and washed with 5% NaCl (2×150 mL) and saturated NaCl (1×150 mL). Organic layer dried over $Na_2SO_4$, filtered, and concentrated under reduced pressure at 25° C. Dried under high vacuum overnight. No further purification. Compound 521 was isolated as a white foam, 97% yield (2.28 g). $^1$H NMR (400 MHz, DMSO-$d_6$) δ 11.22 (s, 1H), 8.74 (d, J=15.4 Hz, 2H), 8.11-7.94 (m, 3H), 7.64 (t, J=7.4 Hz, 1H), 7.54 (t, J=7.6 Hz, 2H), 6.12 (d, J=6.2 Hz, 1H), 5.38 (s, 1H), 4.53 (t, J=5.5 Hz, 1H), 4.30 (t, J=4.0 Hz, 1H), 4.02-3.92 (m, 1H), 3.55-3.21 (m, 5H), 2.08 (t, J=7.4 Hz, 2H), 1.55-1.40 (m, J=6.8 Hz, 2H), 1.20 (d, J=4.7 Hz, 20H), 0.83 (t, J=6.7 Hz, 3H).

Compound 522: Compound 522 was synthesized from compound 512 in an analogous fashion to compound 521. Compound 522 was isolated in 96% yield (2.42 g). $^1$H NMR (400 MHz, DMSO-$d_6$) δ 11.22 (s, 1H), 8.74 (d, J=15.8 Hz, 2H), 8.10-7.94 (m, 3H), 7.64 (t, J=7.4 Hz, 1H), 7.54 (t, J=7.6 Hz, 2H), 6.12 (d, J=6.2 Hz, 1H), 5.38 (d, J=5.4 Hz, 1H), 4.53 (t, J=5.6 Hz, 1H), 4.32-4.27 (m, 1H), 4.02-3.94 (m, 1H), 3.52-3.24 (m, 5H), 2.12-2.02 (m, 2H), 1.53-1.40 (m, J=6.9 Hz, 2H), 1.20 (d, J=6.9 Hz, 24H), 0.83 (t, J=6.7 Hz, 3H).

Compound 523: Compound 523 was synthesized from compound 513 in an analogous fashion to compound 521. Compound 523 was isolated in 100% yield (2.57 g). $^1$H NMR (400 MHz, DMSO-$d_6$) δ 11.24 (s, 1H), 8.74 (d, J=12.6 Hz, 2H), 8.08-7.97 (m, 3H), 7.67-7.59 (m, 1H), 7.59-7.49 (m, 2H), 6.12 (d, J=6.2 Hz, 1H), 5.40 (s, 1H), 4.53 (dd, J=6.3, 4.9 Hz, 1H), 4.30 (dd, J=4.9, 3.3 Hz, 1H), 4.01-3.93 (m, 1H), 3.51-3.23 (m, 5H), 2.08 (t, J=7.4 Hz, 2H), 1.51-1.41 (m, 2H), 1.19 (d, J=7.9 Hz, 28H), 0.86-0.78 (m, 3H). $^{13}$C NMR (101 MHz, DMSO-$d_6$) δ 172.45, 165.58, 151.68, 150.55, 143.53, 133.27, 132.44, 128.48, 128.42, 85.62, 84.20, 81.58, 69.46, 57.51, 40.82, 35.33, 31.28, 29.04, 29.00, 28.94, 28.81, 28.70, 28.68, 25.24, 22.08, 13.92.

Compound 524: Compound 524 was synthesized from compound 514 in an analogous fashion to compound 521. Compound 524 was isolated as a white solid, 98% yield (1.67 g). $^1$H NMR (400 MHz, DMSO-$d_6$) δ 9.58 (s, 1H), 8.70 (d, J=1.4 Hz, 1H), 8.33 (d, J=1.7 Hz, 1H), 8.08-7.99 (m, 2H), 7.69-7.62 (m, 1H), 7.58-7.52 (m, 2H), 7.47-7.38 (m, 1H), 6.04 (t, J=6.4 Hz, 1H), 4.71-4.54 (m, 2H), 4.41-4.26 (m, 1H), 3.99-3.63 (m, 5H), 3.44-3.29 (m, 4H), 2.83-2.67 (m, 2H), 2.34-2.16 (m, 3H), 1.67-1.52 (m, 2H), 1.35-1.17 (m, 36H), 0.88 (t, J=6.8 Hz, 3H).

Compound 531: Compound 521 (2.24 g, 3.7 mmol) was dissolved in anhydrous THF (20 mL) under an argon atmosphere. N,N-diisopropylethylamine (0.86 mL, 4.9 mmol) and 2-cyanoethyl N,N-diisopropylchlorophosphoramidite (1.1 mL, 4.9 mmol) were added and stirred at rt for 3 h. Triethanolamine (3.7 mL, 10 mmol, 2.7 M solution in acetonitrile:toluene (4:9)) was added to the reaction mixture and stirred for 5 minutes. The reaction mixture was diluted with ethyl acetate (80 mL), concentrated under reduced pressure to 30 mL, diluted with ethyl acetate (50 mL), then washed with 5% NaCl (3×100 mL) and saturated NaCl (1×100 mL). Organic layer dried over $Na_2SO_4$, filtered, and concentrated to a foam under reduced pressure. Purification by silica gel flash chromatography, 80 g silica column, ethyl acetate (+0.5% triethylamine):hexanes (1:1 to 100% ethyl acetate gradient). Concentrated fractions under reduced pressure and chased with acetonitrile (2×). Dried under high vacuum overnight. Compound 531 was isolated as a white foam, 67% yield (2.00 g). $^1$H NMR (400 MHz, Acetonitrile-$d_3$) δ 8.70 (d, J=1.4 Hz, 1H), 8.33 (d, J=1.7 Hz, 1H), 8.08-7.99 (m, 2H), 7.69-7.62 (m, 1H), 7.55 (t, J=7.7 Hz, 2H), 7.48-7.40 (m, 1H), 6.04 (t, J=6.4 Hz, 1H), 4.71-4.54 (m, 2H), 4.41-4.26 (m, 1H), 3.99-3.63 (m, 5H), 3.44-3.29 (m, 4H), 2.83-2.67 (m, 2H), 2.34-2.16 (m, 3H), 1.67-1.52 (m, 2H), 1.35-1.17 (m, 32H), 0.88 (t, J=6.8 Hz, 3H). $^{13}$C NMR (101 MHz, Acetonitrile-$d_3$) δ 174.21, 174.15, 152.70, 151.40, 144.57, 144.48, 134.89, 133.66, 129.70, 129.21, 126.33, 119.73, 119.66, 88.57, 85.59, 82.48, 72.19, 60.24, 60.07, 59.43, 59.23, 59.12, 59.07, 58.64, 44.35, 44.23, 44.18, 44.05, 41.61, 41.46, 37.07, 37.02, 32.70, 30.45, 30.43, 30.41, 30.30, 30.19, 30.14, 30.10, 30.07, 26.56, 26.51, 25.12, 25.04, 24.99, 24.96, 24.93, 23.46, 21.15, 21.12, 21.08, 21.05, 14.47. $^{31}P$ NMR (162 MHz, Acetonitrile-$d_3$) δ 150.87, 149.79.

Compound 532: Compound 532 was synthesized from compound 522 in an analogous fashion to compound 531. Compound 532 was isolated as a white foam, 81% yield (2.56 g). $^{1}H$ NMR (400 MHz, Acetonitrile-$d_3$) δ 9.56 (s, 1H), 8.71 (d, J=1.3 Hz, 1H), 8.33 (d, J=1.6 Hz, 1H), 8.07-7.96 (m, 2H), 7.66 (t, J=7.4 Hz, 1H), 7.56 (t, J=7.6 Hz, 2H), 7.46-7.38 (m, 1H), 6.04 (t, J=6.3 Hz, 1H), 4.71-4.53 (m, 2H), 4.41-4.25 (m, 1H), 3.99-3.63 (m, 5H), 3.44-3.30 (m, 4H), 2.82-2.67 (m, 2H), 2.31-2.18 (m, 3H), 1.65-1.52 (m, 2H), 1.35-1.18 (m, 35H), 0.89 (t, J=6.8 Hz, 3H). $^{13}C$ NMR (101 MHz, Acetonitrile-$d_3$) δ 174.21, 174.14, 152.70, 151.41, 144.57, 144.48, 134.90, 133.67, 129.72, 129.21, 126.34, 126.29, 119.66, 88.58, 85.59, 85.49, 85.46, 72.02, 60.25, 60.07, 59.43, 59.24, 59.12, 59.08, 58.64, 44.36, 44.24, 44.18, 44.06, 41.60, 41.46, 37.08, 37.02, 32.71, 30.46, 30.44, 30.43, 30.40, 30.30, 30.18, 30.15, 30.10, 30.07, 26.56, 26.51, 25.13, 25.05, 25.00, 24.96, 24.93, 23.46, 21.15, 21.12, 21.09, 21.05, 14.48. $^{31}P$ NMR (162 MHz, Acetonitrile-$d_3$) δ 150.87, 149.80.

Compound 533: Compound 533 was synthesized from compound 523 in an analogous fashion to compound 531. Compound 533 was isolated in 89% yield (2.95 g). $^{1}H$ NMR (400 MHz, Acetonitrile-$d_3$) 69.63 (s, 1H), 8.69 (d, J=1.4 Hz, 1H), 8.33 (d, J=1.5 Hz, 1H), 8.07-7.97 (m, 2H), 7.70-7.60 (m, 1H), 7.58-7.51 (m, 2H), 7.48-7.40 (m, 1H), 6.04 (t, J=6.6 Hz, 1H), 4.71-4.52 (m, 2H), 4.41-4.25 (m, 1H), 3.99-3.64 (m, 5H), 3.44-3.29 (m, 4H), 2.82-2.69 (m, 2H), 2.37-2.15 (m, 3H), 1.65-1.52 (m, 2H), 1.45-1.16 (m, 39H), 0.94-0.84 (m, 3H). $^{13}C$ NMR (101 MHz, Acetonitrile-$d_3$) δ 174.20, 174.13, 166.46, 152.68, 151.41, 151.39, 144.57, 144.47, 134.89, 133.65, 129.69, 129.21, 126.33, 126.28, 119.71, 119.64, 88.57, 85.58, 85.49, 85.45, 82.51, 82.48, 72.19, 60.24, 60.07, 59.43, 59.23, 59.12, 59.07, 58.64, 44.35, 44.23, 44.18, 44.05, 41.62, 41.47, 37.08, 37.02, 32.71, 30.48, 30.46, 30.44, 30.43, 30.41, 30.30, 30.19, 30.15, 30.11, 30.08, 26.56, 26.51, 25.13, 25.05, 25.00, 24.97, 24.94, 23.46, 21.15, 21.12, 21.08, 21.05, 14.49. $^{31}P$ NMR (162 MHz, Acetonitrile-$d_3$) δ 150.87, 149.79.

Compound 534: Compound 534 was synthesized from compound 524 in an analogous fashion to compound 531. Compound 534 was isolated as a white foam, 77% yield (1.65 g). $^{1}H$ NMR (400 MHz, Acetonitrile-$d_3$) δ 9.56 (s, 1H), 8.71 (d, J=1.4 Hz, 1H), 8.33 (d, J=1.7 Hz, 1H), 8.07-7.98 (m, 2H), 7.69-7.62 (m, 1H), 7.60-7.51 (m, 2H), 7.48-7.33 (m, 1H), 6.04 (t, J=6.4 Hz, 1H), 5.38-5.27 (m, 2H), 4.71-4.54 (m, 2H), 4.41-4.26 (m, 1H), 3.99-3.63 (m, 5H), 3.45-3.29 (m, 4H), 2.84-2.67 (m, 2H), 2.34-2.17 (m, 3H), 2.09-1.92 (m, 3H), 1.66-1.52 (m, 2H), 1.39-1.18 (m, 32H), 0.94-0.83 (m, 3H). $^{13}C$ NMR (101 MHz, Acetonitrile-$d_3$) δ 174.11, 152.70, 151.40, 144.56, 134.90, 133.67, 130.83, 130.76, 129.71, 129.21, 118.34, 88.57, 44.36, 44.23, 44.18, 44.05, 41.62, 41.47, 37.07, 37.01, 32.69, 30.52, 30.50, 30.25, 30.10, 30.07, 30.04, 29.91, 27.86, 26.56, 26.51, 25.13, 25.05, 25.00, 24.97, 24.93, 23.45, 14.48, 2.01, 1.19. $^{31}P$ NMR (162 MHz, Acetonitrile-$d_3$) δ 150.86, 149.79.

Synthesis of Sterically Hindered Ester-Containing Lipid

Scheme 29

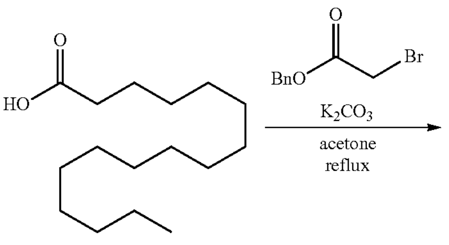

601

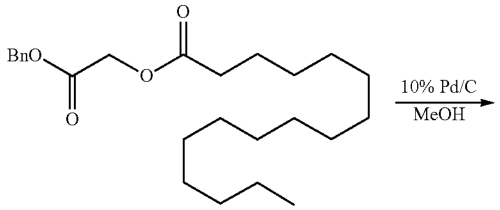

602

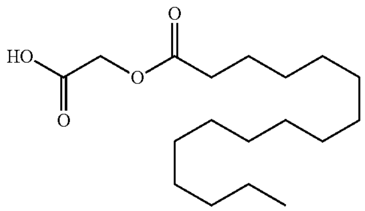

603

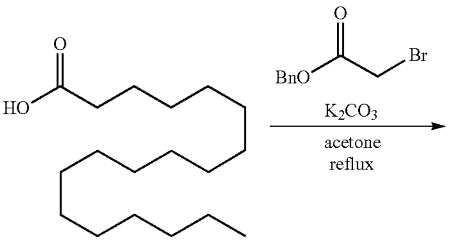

604

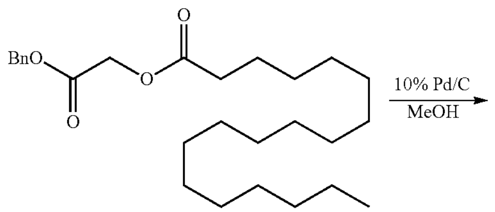

605

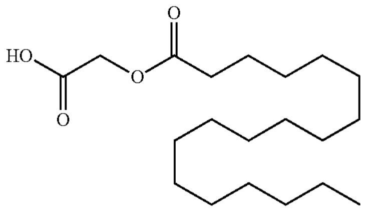

606

-continued
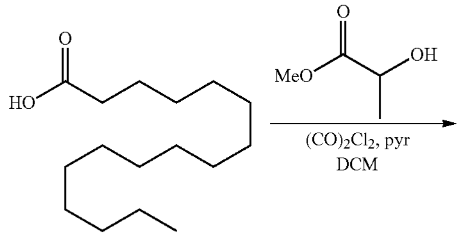
607
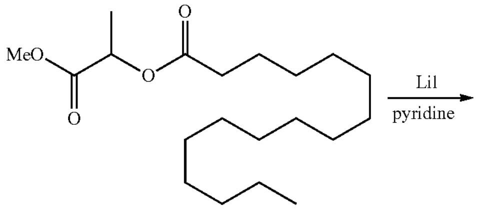
608
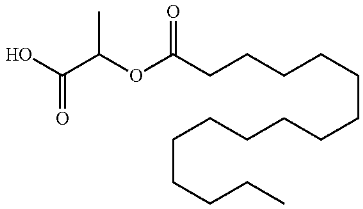
609
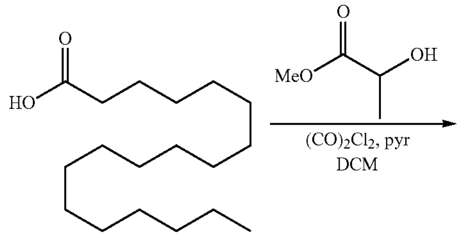
607
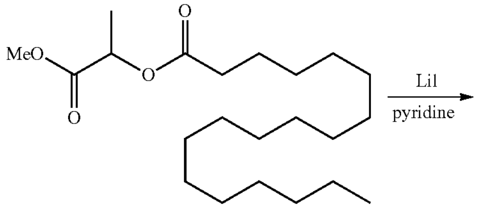
608
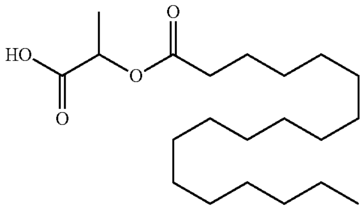
609
-continued
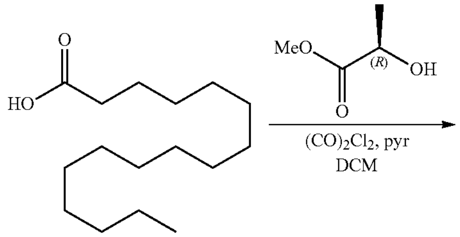
607
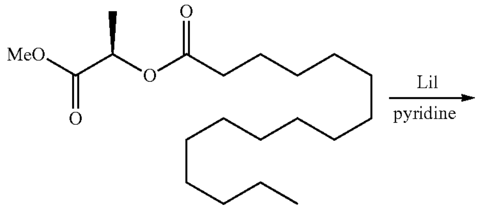
613
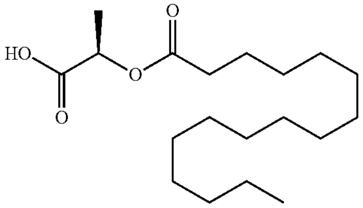
614
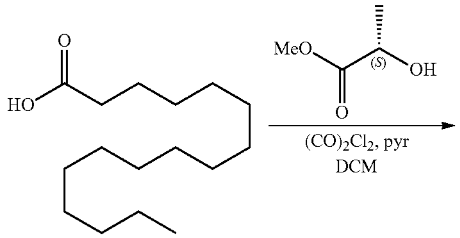
607
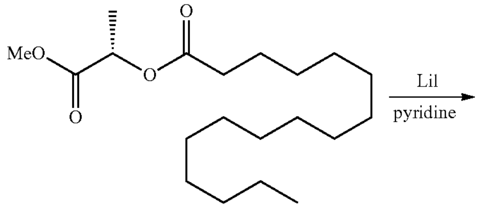
615
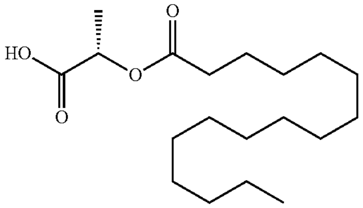
616

-continued

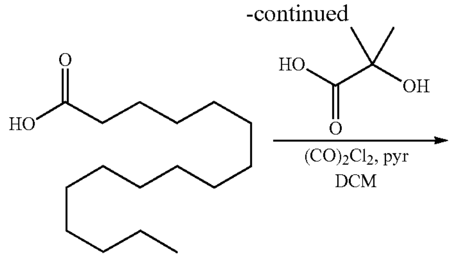

607

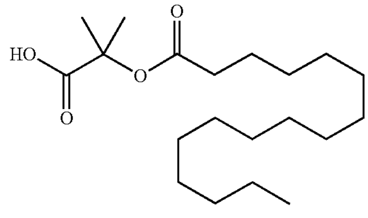

617

Compound 603: Palmitic acid 601 (3.53 g, 13.1 mmol) and potassium carbonate (3.71 g, 26.85 mmol) were added to a stirred solution of benzyl 2-bromoacetate (3.0 g, 13.1 mmol, 2.05 mL) in acetone (250 mL). After heating at reflux for 24 h, the reaction mixture was cooled to room temperature and filtrated to remove the excess of $K_2CO_3$. The filtrate was evaporated under reduced pressure, and the residue was partitioned between diethyl ether and (50 mL) and water (50 mL). The organic fraction was dried over $MgSO_4$, filtered and evaporated under reduced pressure to give the crude benzyl ester 602 (5.2 g). The residue was dissolved in a 4:1 mixture of ethyl acetate/methanol (100 mL), followed by addition of 10% Pd/C (0.75 g, 0.71 mmol). The flask was equipped with a three-way adapter connected to a rubber balloon filled with Hydrogen, and to the vacuum line. The flask was placed under vacuum for 20 s, followed by refilling with Hydrogen. The sequence was repeated two more times. After 4 h, the reaction mixture was filtered through a celite pad, the filtride was rinsed with ethyl acetate (×3) and methanol (×2). The combined filtrate was evaporated under reduced pressure. The residue was purified by ISCO automated column using 0-20% EtOAc in hexanes (the hexanes contained 1% of acetic acid) as eluant to give compound 603 (2.22 g, 51%). $^1$H NMR (500 MHz, $CDCl_3$) δ 4.67 (s, 2H), 2.42 (t, J=7.5 Hz, 2H), 1.66 (p, J=7.5 Hz, 2H), 1.38-1.23 (m, 23H), 0.88 (t, J=6.9 Hz, 3H).

Compound 606: Stearic acid 604 (2.0 g, 7.03 mmol) and potassium carbonate (1.99 g, 14.41 mmol) were added to a stirred solution of benzyl 2-bromoacetate (1.61 g, 7.03 mmol) in acetone (250 mL). After heating at reflux for 24 h, the reaction mixture was cooled to room temperature and filtrated to remove the excess of $K_2CO_3$. The filtrate was evaporated under reduced pressure, and the residue was partitioned between diethyl ether and water (50 mL). The organic fraction was dried over $MgSO_4$, filtered and evaporated under reduced pressure to give the crude benzyl ester 5 (3.0 g). The residue was dissolved in a 1:1 mixture of ethyl acetate/methanol (100 mL), followed by addition of 10% Pd/C (738 mg, 0.693 mmol). The flask was equipped with a three-way adapter connected to a rubber balloon filled with Hydrogen, and to the vacuum line. The flask was placed under vacuum for 20 s, followed by refilling with Hydrogen. The sequence was repeated two more times. After 4 h, the reaction mixture was filtered through a celite pad, the filtride was rinsed with ethyl acetate (×3) and methanol (×2). The combined filtrate was evaporated under reduced pressure. The residue was purified by ISCO automated column using 0-20% EtOAc in hexanes (the hexanes contained 1% of acetic acid) as eluant to give compound 6 (1.5 g, 62% over 2 steps). $^1$H NMR (400 MHz, DMSO-d6) δ 4.53 (s, 2H), 2.35 (t, J=7.4 Hz, 2H), 1.59-1.49 (m, 2H), 1.23 (s, 28H), 0.85 (t, J=6.7 Hz, 3H).

Compound 609: Palmitic acid 607 (2.66 g, 10.37 mmol) was dissolved in dry DCM (100 mL) under Argon and cooled to 0° C. Oxalyl chloride (2 M, 10.37 mL, 20.73 mmol) was added followed by DMF (one drop). The ice bath was removed, and the reaction mixture was stirred at room temperature. When the evolution of gas stopped (ca. 2 h), the mixture was concentrated in vacuo to give crude palmoil chloride. In another flask, methyl 2-hydroxypropanoate (0.9 mL, 9.42 mmol) was dissolved in dry DCM (60 mL) followed by addition of pyridine (3.81 mL, 47.1 mmol). The reaction mixture was cooled to 0° C., followed by dropwise addition of a solution of the palmoil chloride in DCM (10 mL) via cannula. The ice bath was removed, and the reaction was stirred overnight. The reaction was quenched with deionized water (50 mL) and stirred vigorously for 30 minutes. The biphasic mixture was transferred to a separatory funnel. The layers were partitioned and separated. The organic layer was saved while the aqueous layer was extracted with dichloromethane (150 mL×2). Organics were combined and washed with 1 M aqueous hydrochloric acid, saturated aqueous sodium bicarbonate, brine, dried (sodium sulfate), filtered and concentrated. The crude residue was purified by ISCO automated column using 0-10% EtOAc in hexanes as eluant to give compound 608 (2.28 g, 70%). $^1$H NMR (500 MHz, Chloroform-d) δ 5.10 (q, J=7.1 Hz, 1H), 3.74 (s, 3H), 2.37 (hept, J=7.7 Hz, 2H), 1.64 (h, J=7.1 Hz, 2H), 1.48 (d, J=7.1 Hz, 3H), 1.36-1.23 (m, 24H), 0.88 (t, J=6.8 Hz, 3H). Lithium Iodide ((3.89 g, 29.05 mmol) was added to a stirred solution of compound 608 (2 g, 5.84 mmol) in anhydrous pyridine (30 mL). After stirring for 24 h at reflux, the mixture was evaporated. The residual oil was suspended with a mixture of 1 M HCl and EtOAc. The layers were separated and the aqueous layer was extracted with EtOAc (×3). The organic extracts were combined, washed with a saturated aqueous solution of sodium thiosulfate, brine, dried over $Na_2SO_4$ and pre-adsorbed in silica gel. The residue was purified by ISCO automated column using 0-20% MeOH in $CH_2Cl_2$ as eluant to give compound 609 (1.01 g, 52%). $^1$H NMR (400 MHz, DMSO-d6) δ 12.94 (s, 1H), 4.88 (q, J=7.1 Hz, 1H), 2.32 (t, J=7.3 Hz, 2H), 1.57-1.47 (m, 2H), 1.37 (d, J=7.1 Hz, 3H), 1.24 (s, 24H), 0.88-0.83 (m, 3H).

Compound 612: Stearic acid 610 (2.95 g, 10.37 mmol) was dissolved in dry DCM (100 mL) under Argon and cooled to 0° C. oxalyl chloride (2 M, 10.37 mL, 20.73 mmol) was added followed by DMF (one drop). The ice bath was removed, and the reaction mixture was stirred at room temperature. When the evolution of gas stopped (ca. 2 h), the mixture was concentrated in vacuo to give crude stearyl chloride. In another flask, methyl 2-hydroxypropanoate (0.981 g, 9.42 mmol, 0.9 mL) was dissolved in dry DCM (60 mL) followed by addition of pyridine (3.81 mL, 47.12 mmol). The reaction mixture was cooled to 0° C., followed by dropwise addition of a solution of the stearyl chloride in DCM (10 mL) via cannula. The ice bath was removed, and the reaction was stirred overnight. The reaction was quenched with deionized water (50 mL) and stirred vigorously for 30 minutes. The biphasic mixture was transferred to a separatory funnel. The layers were partitioned and separated. The organic layer was saved while the aqueous layer was extracted with dichloromethane (150 mL×2). Organics were combined and washed with 1 M aqueous hydrochloric acid, saturated aqueous sodium bicarbonate, brine, dried (sodium sulfate), filtered and concentrated. The crude residue was purified by ISCO automated column using 0-10% EtOAc in hexanes as eluant to give compound 611 (3.09 g, 88%). $^1$H NMR (500 MHz, Chloroform-d) δ 5.10 (q, J=7.1 Hz, 1H), 3.75 (s, 3H), 2.38 (td, J=7.6, 6.2 Hz, 2H), 1.64 (q, J=7.4 Hz, 2H), 1.48 (d, J=7.0 Hz, 3H), 1.32-1.23 (m, 28H), 0.88 (t, J=6.9 Hz, 3H). Lithium Iodide (5.58 g, 41.7 mmol) was added to a stirred solution of compound 611 (3.09 g, 8.34 mmol) in anhydrous pyridine (40 mL). After stirring for 24 h at reflux, the mixture was evaporated. The residual oil was suspended with a mixture of 1 M HCl and EtOAc. The layers were separated and the aqueous layer was extracted with EtOAc (×3). The organic extracts were combined, washed with a saturated aqueous solution of sodium thiosulfate, brine, dried over $Na_2SO_4$ and pre-adsorbed in silica gel. The residue was purified by ISCO automated column using 0-20% MeOH in $CH_2Cl_2$ as eluant to give compound 612 (1.29 g, 43%). $^1$H NMR (400 MHz, DMSO-d6) δ 12.94 (s, 1H), 2.32 (t, J=7.3 Hz, 2H), 1.59-1.47 (m, 2H), 1.37 (d, J=7.1 Hz, 3H), 1.23 (s, 28H), 0.85 (t, J=6.7 Hz, 3H).

Compound 614: Palmitic acid 607 (2.66 g, 10.37 mmol) was dissolved in dry DCM (100 mL) under Argon and cooled to 0° C. Oxalyl chloride (2 M, 10.37 mL, 20.73 mmol) was added followed by DMF (one drop). The ice bath was removed, and the reaction mixture was stirred at room temperature. When the evolution of gas stopped (ca. 2 h), the mixture was concentrated in vacuo to give crude palmoil chloride. In another flask, methyl-(R)-lactate (0.9 mL, 9.42 mmol) was dissolved in dry DCM (60 mL) followed by addition of pyridine (3.81 mL, 47.1 mmol). The reaction mixture was cooled to 0° C., followed by dropwise addition of a solution of the palmoil chloride in DCM (10 mL) via cannula. The ice bath was removed, and the reaction was stirred overnight. The reaction was quenched with deionized water (50 mL) and stirred vigorously for 30 minutes. The biphasic mixture was transferred to a separatory funnel. The layers were partitioned and separated. The organic layer was saved while the aqueous layer was extracted with dichloromethane (150 mL×2). Organics were combined and washed with 1 M aqueous hydrochloric acid, saturated aqueous sodium bicarbonate, brine, dried (sodium sulfate), filtered and concentrated. The crude residue was purified by ISCO automated column using 0-10% EtOAc in hexanes as eluant to give compound 613 (2.28 g, 70%). $^1$H NMR (400 MHz, Chloroform-d) δ 5.08 (q, J=7.1 Hz, 1H), 3.73 (s, 3H), 2.43-2.27 (m, 2H), 1.63 (p, J=7.4 Hz, 2H), 1.47 (d, J=7.1 Hz, 3H), 1.33-1.21 (m, 24H), 0.89-0.82 (m, 3H). Lithium Iodide was added to a stirred solution of compound 613 in anhydrous pyridine (40 mL). After stirring for 24 h at reflux, the mixture was evaporated. The residual oil was suspended with a mixture of 1 M HCl and EtOAc. The layers were separated and the aqueous layer was extracted with EtOAc (×3). The organic extracts were combined, washed with a saturated aqueous solution of sodium thiosulfate, brine, dried over $Na_2SO_4$ and pre-adsorbed in silica gel. The residue was purified by ISCO automated column using 0-20% MeOH in $CH_2Cl_2$ as eluant to give compound 614.

Compound 616: Palmitic acid 607 (2.66 g, 10.37 mmol) was dissolved in dry DCM (100 mL) under Argon and cooled to 0° C. oxalyl chloride (2 M, 10.37 mL, 20.73 mmol) was added followed by DMF (one drop). The ice bath was removed, and the reaction mixture was stirred at room temperature. When the evolution of gas stopped (ca. 2 h), the mixture was concentrated in vacuo to give crude palmoil chloride. In another flask, methyl-(S)-lactate (0.9 mL, 9.42 mmol) was dissolved in dry DCM (60 mL) followed by addition of pyridine (3.81 mL, 47.1 mmol). The reaction mixture was cooled to 0° C., followed by dropwise addition of a solution of the palmoil chloride in DCM (10 mL) via cannula. The ice bath was removed, and the reaction was stirred overnight. The reaction was quenched with deionized water (50 mL) and stirred vigorously for 30 minutes. The biphasic mixture was transferred to a separatory funnel. The layers were partitioned and separated. The organic layer was saved while the aqueous layer was extracted with dichloromethane (150 mL×2). Organics were combined and washed with 1 M aqueous hydrochloric acid, saturated aqueous sodium bicarbonate, brine, dried (sodium sulfate), filtered and concentrated. The crude residue was purified by ISCO automated column using 0-10% EtOAc in hexanes as eluant to give compound 615 (2.28 g, 65%). $^1$H NMR (500 MHz, Chloroform-d) δ 5.10 (q, J=7.1 Hz, 1H), 3.74 (s, 3H), 2.44-2.32 (m, 2H), 1.65 (p, J=7.4 Hz, 2H), 1.48 (d, J=7.0 Hz, 3H), 1.39-1.22 (m, 24H), 0.88 (t, J=6.9 Hz, 3H). Lithium Iodide (3.91 g, 29.2 mmol) was added to a stirred solution of compound 615 (2.0 g, 5.8 mmol) in anhydrous pyridine (30 mL). After stirring for 24 h at reflux, the mixture was evaporated. The residual oil was suspended with a mixture of 1 M HCl and EtOAc. The layers were separated and the aqueous layer was extracted with EtOAc (×3). The organic extracts were combined, washed with a saturated aqueous solution of sodium thiosulfate, brine, dried over $Na_2SO_4$ and pre-adsorbed in silica gel. The residue was purified by ISCO automated column using 0-20% MeOH in $CH_2Cl_2$ as eluant to give compound 616 (1.1 g, 57%). $^1$H NMR (500 MHz, Chloroform-d) δ 5.12 (q, J=7.1 Hz, 1H), 2.38 (td, J=7.6, 4.4 Hz, 2H), 1.69-1.60 (m, 2H), 1.53 (d, J=7.1 Hz, 3H), 1.37-1.24 (m, 24H), 0.88 (t, J=6.9 Hz, 3H).

Compound 617: Palmitic acid 607 (2.6 g, 10.1 mmol) was dissolved in dry DCM (100 mL) under Argon and cooled to 0° C. oxalyl chloride (1.75 mL, 20.3 mmol) was added followed by DMF (one drop). The ice bath was removed, and the reaction mixture was stirred at room temperature. When the evolution of gas stopped (ca. 2 h), the mixture was concentrated in vacuo to give crude palmoil chloride. In another flask, 2-hydroxy-2-methylpropanoic acid (1.0 mL, 10.1 mmol) was dissolved in dry DCM (60 mL) followed by addition of pyridine (4.1 mL, 50.7 mmol). The reaction mixture was cooled to 0° C., followed by dropwise addition of a solution of the palmoil chloride in DCM (20 mL) via cannula. The ice bath was removed, and the reaction was stirred overnight. The reaction was quenched with an aqueous saturated solution of $NH_4Cl$. The biphasic mixture was transferred to a separatory funnel and the layers were separated. The aqueous layer was extracted with dichloromethane (150 mL×2). The combined organics layers were combined and washed with 1 M aqueous hydrochloric acid, saturated aqueous sodium bicarbonate, brine, dried over $Na_2SO_4$, filtered and concentrated. The crude residue was purified by ISCO automated column using 0-10% EtOAc in hexanes as eluant to give compound 617 (200 mg, 6%). $^1$H NMR (400 MHz, Chloroform-d) δ 2.93 (s, 2H), 2.22 (t, J=7.5 Hz, 2H), 1.55 (s, 6H), 1.29 (s, 24H), 0.87 (t, J=6.5 Hz, 3H).

Cleavable Ceramide-Type Linkers

Ceramidases (CDases) are key enzymes of sphingolipid metabolism that regulate the formation and degradation of ceramides. A ceramide is composed of sphingosine and a fatty acid as depicted below.

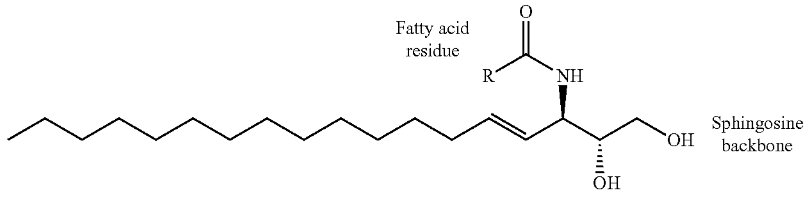

Ceramide general structure

The enzymatic degradation of ceramides by cleavage of the amide bond, is controlled by three families of CDases (acid, neutral, and alkaline) which are distinguished by their pH optima, subcellular location, primary structure, mechanism, and function.

Based on the proposed mechanism and the structural requirements of human neutral CDases, we proposed the synthesis of 2'-O-ceramide-type nucleosides phosphoramidates. The synthesized monomers nucleosides will be introduced strategically into siRNA and once in the body, will be cleaved selectively by CDases, releasing the fatty acid and the oligonucleotide chain.

The synthesis started using compound 701 which is commercially available or can be prepared in 2 steps from uridine (Scheme 1). Cross metathesis of the terminal alkene at the 2'-position of the nucleoside with a derivate of (S)-allylglycine gave compound 702. Hydrogenation of the internal alkene followed by formation of the phosphoramidate afforded compound 703.

Scheme 30

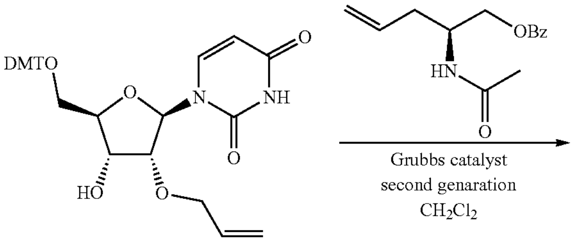

701

-continued

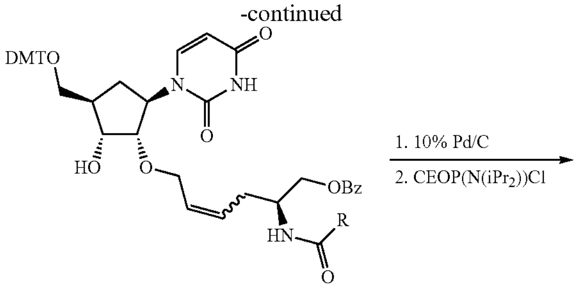

$R = -((CH)_2)_{14}CH_3$

702

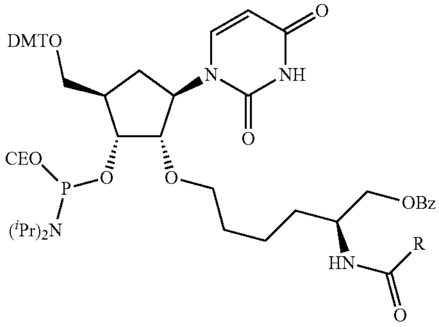

$R = -((CH)_2)_{14}CH_3$

703

Example 5: Post-Synthetic Conjugation of Ligands (e.g., Lipophilic Moities) to siRNA Scheme 31

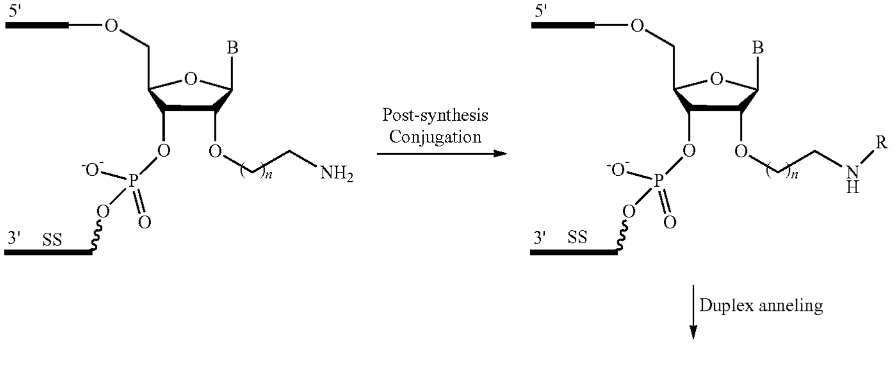

-continued

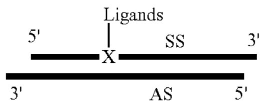

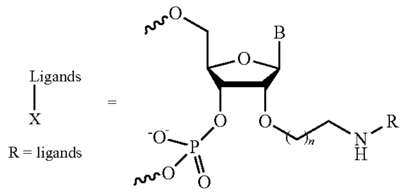

Scheme 32

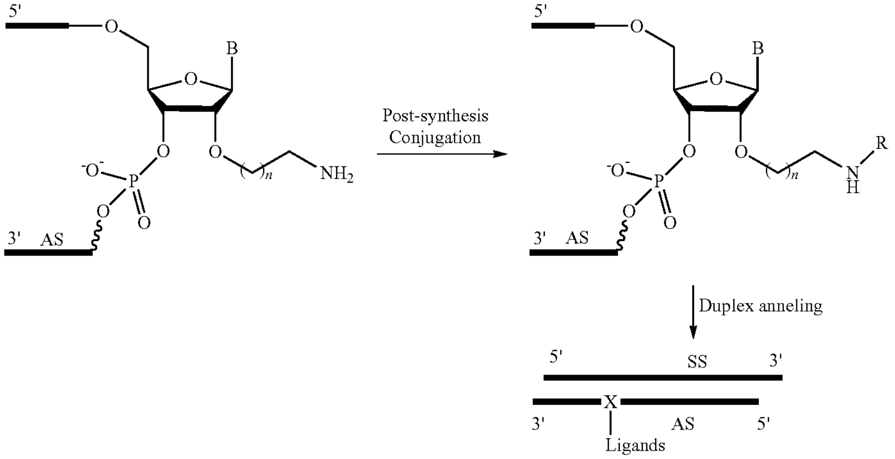

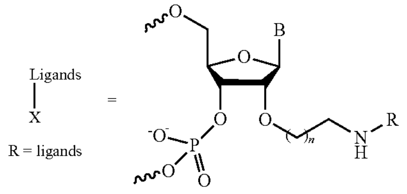

Various ligands, including various lipophilic moieties is conjugated to siRNA agents via post-synthesis conjugation methods, as shown in Schemes 9 and 10. Amino derivative of sense or antisense strand of siRNA is reacted either with NHS esters of lipophilic ligands or carboxylic acids under peptide coupling conditions. These singles strands are then purified and combined with other strands to make siRNA duplexes.

Example 6: Synthesis of siRNA Conjugates Having Terminal Acids Functionality

Scheme 33

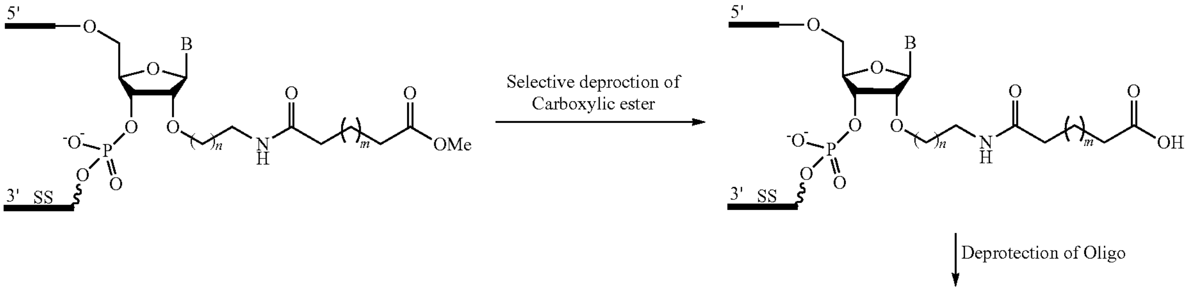

-continued

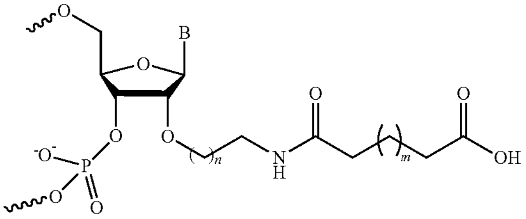

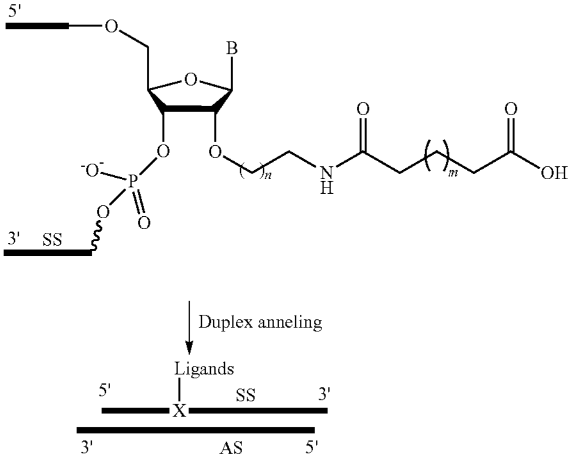

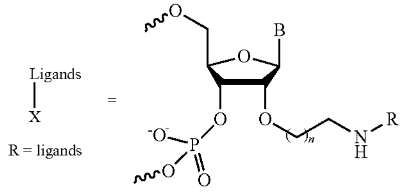

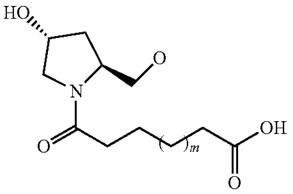

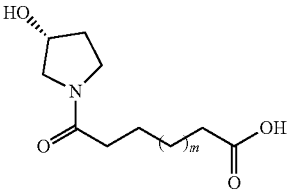

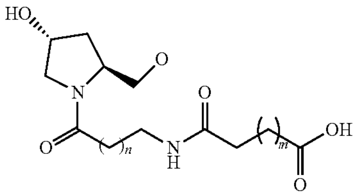

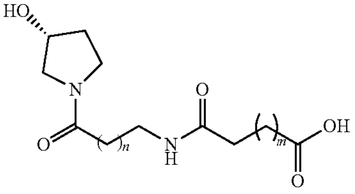

Various ligands, including various lipophilic having carboxylic moieties is conjugated to siRNA agents at terminals and internal positions as shown in scheme 33 via on column or post-synthetic conjugation. Solid supported single strands containing lipophilic moieties having terminal esters are first treated with 20% piperidine in water overnight followed by 2:1 $NH_4OH$ in ethanol for 15 hrs at room temperature to generate single strands having terminal carboxylic acids. These single strands are combined with corresponding antisense strands to generate siRNA duplexes for various assays.

Example 7. Additional Conjugated dsRNA Agent for Ocular Administration

Further dsRNA agents conjugated to alternative ligands are designed and synthesized as described above.

Example 8. In Vivo Efficacy of the Additional dsRNA Agent for Ocular Administration To assess the efficacy of the additional agents, a single 7.5 microgram dose of the siRNA agents conjugated with lipophilic moiety or cleavable liphophilic moiety as described above is intravitreally administered to mice on Day 0. On 7 retinal tissue is collected and C3 mRNA levels are determined by quantitative PCR, as described above.

Example 9. In Vitro Efficacy of the Additional dsRNA Agent for Ocular Administration To assess the efficacy of the additional agents conjugated with abasic lipohilic ligand, a single dose screen of the agents is performed as described above in primary mouse RPE. The cells are transfected with 0.1 nM, 1.0 nM, or 10 nM of the agents and twenty-four hours later the level of C3 mRNA is determined by quantitative PCR, as described above.

Example 10. Metabolic Stability Determination of siRNA Conjugates in Various Matrices In vitro stability of selected dsRNA agents is assessed using the methods below.

Stability of Ligands in Cerebral Spinal Fluid (CSF)

Stability of ligands are assessed by incubating 50 μL of rat derived CSF (BioIVT, Cat. RAT00CSFXZN), with 12.5 μL of siRNA (0.1 mg/mL) in a 96-well plate for 24 h at 37° C. with gentle shaking. After which, protein is digested by adding 25 μL of a proteinase K solution containing 0.0875 mg proteinase K in 4.1% Tween 20, 0.3% Triton X-100, 24.7 mM Tris-HCl, pH 8.0 and incubating for 1 h at 50° C. with gentle shaking. Samples are then diluted with 450 μL lysis buffer (Phenomenex, Cat. AL0-8579) that is adjusted to pH 5.5 using ammonium hydroxide in preparation for solid phase extraction.

Stability of Ligands in Brain Homogenate

Stability of ligands are assessed by incubating 50 μL of rat brain homogenate (BioIVT, Cat. S05966) with 12.5 μL of siRNA (0.1 mg/mL) in a 96-well plate for 24 h at 37° C. with gentle shaking. After which, protein is digested by adding 25 μL of a proteinase K solution containing 0.0875 mg proteinase K in 4.1% Tween 20, 0.3% Triton X-100, 24.7 mM Tris-HCl, pH 8.0 and incubating for 1 h at 50° C. with gentle shaking. Samples are then diluted with 450 μL lysis buffer (Phenomenex, Cat. AL0-8579) that is adjusted to pH 5.5 using ammonium hydroxide in preparation for solid phase extraction.

Stability of Ligands In Vitreous Humor

Stability of ligands are assessed by incubating 50 μL of rabbit derived (BioIVT, Cat. RAB00VITHUMPZN) or cynomologous monkey derived (BioIVT, Cat. NHP01HUMPZN) vitreous humor with 12.5 μL of siRNA (0.1 mg/mL) in a 96-well plate for 24 h at 37° C. with gentle shaking. After which, protein is digested by adding 25 μL of a proteinase K solution containing 0.0875 mg proteinase K in 4.1% Tween 20, 0.3% Triton X-100, 24.7 mM Tris-HCl, pH 8.0 and incubating for 1 h at 50° C. with gentle shaking. Samples are then diluted with 450 μL lysis buffer (Phenomenex, Cat. AL0-8579) that is adjusted to pH 5.5 using ammonium hydroxide in preparation for solid phase extraction.

Solid Phase Extraction

Solid phase extraction is then performed using Clarity OTX solid phase extraction plates (Phenomenex, Cat. 8E-S103-EGA). The plate is first conditioned by passing 1 mL methanol through it using a positive pressure manifold, followed by 1.9 mL equilibration buffer (50 mM ammonium acetate with 2 mM sodium azide, pH 5.5), then the samples are loaded onto the column. The column is then washed with 1.5 mL wash buffer (50 mM ammonium acetate in 50% acetonitrile, pH 5.5) 5 times. Samples are eluted with 0.6 mL elution buffer (10 mM EDTA, 100 mM ammonium bicarbonate, 10 mM DTT in 40% acetonitrile and 10% THF, pH 8.8) and dried using nitrogen flow (TurboVap, 65 psi $N_2$ at 40° C.).

Analytical Method

After SPE, samples are reconstituted in 120 μL water, and analyzed using liquid chromatography combined with mass spectrometry detection on a Thermo QExactive by electrospray ionization (ESI). Samples are injected (30 μL) and separated using an XBridge BEH C8 XP Column 130 Å, 2.5 μm, 2.1×30 mm (Waters, Cat. 176002554) maintained at 80° C. Mobile phase A is 16 mM triethylamine and 200 mM hexafluoroisopropanol and mobile phase B is methanol, and a gradient of 0-65% mobile phase B over 6.2 minutes is employed at 1 m/min. The ESI source is operated in negative ion mode, with full scan, using spray voltage=2800 V, sheath gas flow=65 units, auxiliary gas flow=20 units, sweep gas flow=4 units, capillary temperature=300° C., and auxiliary gas heated to 300° C. Promass software is used to deconvolute the signal.

INFORMAL SEQUENCE LISTING

<210> 1
<211> 5148
<212> DNA
<213> *Homo sapiens*
<400> 1

```
agataaaaag ccagctccag caggcgctgc tcactcctcc ccatcctctc cctctgtccc   60

tctgtccctc tgaccctgca ctgtcccagc accatgggac ccacctcagg tcccagcctg  120

ctgctcctgc tactaaccca cctcccccctg gctctgggga gtcccatgta ctctatcatc  180

acccccaaca tcttgcggct ggagagcgag gagaccatgg tgctggaggc ccacgacgcg  240

caaggggatg ttccagtcac tgttactgtc cacgacttcc caggcaaaaa actagtgctg  300

tccagtgaga agactgtgct gacccctgcc accaaccaca tgggcaacgt caccttcacg  360

atcccagcca acagggagtt caagtcagaa aagggggcgca acaagttcgt gaccgtgcag  420

gccaccttcg ggacccaagt ggtggagaag gtggtgctgg tcagcctgca gagcgggtac  480

ctcttcatcc agacagacaa gaccatctac acccctggct ccacagttct ctatcggatc  540

ttcaccgtca accacaagct gctacccgtg ggccggacgg tcatggtcaa cattgagaac  600

ccggaaggca tcccggtcaa gcaggactcc ttgtcttctc agaaccagct tggcgtcttg  660

cccttgtctt gggacattcc ggaactcgtc aacatgggcc agtggaagat ccgagcctac  720

tatgaaaact caccacagca ggtcttctcc actgagtttg aggtgaagga gtacgtgctg  780

cccagtttcg aggtcatagt ggagcctaca gagaaattct actacatcta taacgagaag  840

ggcctggagg tcaccatcac cgccaggttc ctctacggga agaaagtgga gggaactgcc  900

tttgtcatct tcgggatcca ggatggcgaa cagaggattt ccctgcctga atccctcaag  960

cgcattccga ttgaggatgg ctcgggggag gttgtgctga gccggaaggt actgctggac 1020
```

-continued

```
ggggtgcaga acccccgagc agaagacctg gtggggaagt ctttgtacgt gtctgccacc 1080
gtcatcttgc actcaggcag tgacatggtg caggcagagc gcagcgggat ccccatcgtg 1140
acctctccct accagatcca cttcaccaag acacccaagt acttcaaacc aggaatgccc 1200
tttgacctca tggtgttcgt gacgaaccct gatggctctc cagcctaccg agtccccgtg 1260
gcagtccagg gcgaggacac tgtgcagtct ctaacccagg gagatggcgt ggccaaactc 1320
agcatcaaca cacaccccag ccagaagccc ttgagcatca cggtgcgcac gaagaagcag 1380
gagctctcgg aggcagagca ggctaccagg accatgcagg ctctgcccta cagcaccgtg 1440
ggcaactcca acaattacct gcatctctca gtgctacgta cagagctcag acccggggag 1500
accctcaacg tcaacttcct cctgcgaatg gaccgcgccc acgaggccaa gatccgctac 1560
tacacctacc tgatcatgaa caagggcagg ctgttgaagg cgggacgcca ggtgcgagag 1620
cccggccagg acctggtggt gctgcccctg tccatcacca ccgacttcat cccttccttc 1680
cgcctggtgg cgtactacac gctgatcggt gccagcggcc agagggaggt ggtggccgac 1740
tccgtgtggg tggacgtcaa ggactcctgc gtgggctcgc tggtggtaaa aagcggccag 1800
tcagaagacc ggcagcctgt acctgggcag cagatgaccc tgaagataga gggtgaccac 1860
ggggcccggg tggtactggt ggccgtggac aagggcgtgt tcgtgctgaa taagaagaac 1920
aaactgacgc agagtaagat ctgggacgtg gtggagaagg cagacatcgg ctgcaccccg 1980
ggcagtggga aggattacgc cggtgtcttc tccgacgcag ggctgacctt cacgagcagc 2040
agtggccagc agaccgccca gagggcagaa cttcagtgcc cgcagccagc cgcccgccga 2100
cgccgttccg tgcagctcac ggagaagcga atggacaaag tcggcaagta ccccaaggag 2160
ctgcgcaagt gctgcgagga cggcatgcgg gagaacccca tgaggttctc gtgccagcgc 2220
cggacccgtt tcatctccct gggcgaggcg tgcaagaagg tcttcctgga ctgctgcaac 2280
tacatcacag agctgcggcg gcagcacgcg cgggccagcc acctgggcct ggccaggagt 2340
aacctggatg aggacatcat tgcagaagag aacatcgttt cccgaagtga gttcccagag 2400
agctggctgt ggaacgttga ggacttgaaa gagccaccga aaaatggaat ctctacgaag 2460
ctcatgaata tatttttgaa agactccatc accacgtggg agattctggc tgtgagcatg 2520
tcggacaaga aagggatctg tgtggcagac cccttcgagg tcacagtaat gcaggacttc 2580
ttcatcgacc tgcggctacc ctactctgtt gttcgaaacg agcaggtgga aatccgagcc 2640
gttctctaca attaccggca gaaccaagag ctcaaggtga gggtggaact actccacaat 2700
ccagccttct gcagcctggc caccaccaag aggcgtcacc agcagaccgt aaccatcccc 2760
cccaagtcct cgttgtccgt tccatatgtc atcgtgccgc taaagaccgg cctgcaggaa 2820
gtggaagtca aggctgctgt ctaccatcat ttcatcagtg acggtgtcag gaagtccctg 2880
aaggtcgtgc cggaaggaat cagaatgaac aaaactgtgg ctgttcgcac cctggatcca 2940
gaacgcctgg gccgtgaagg agtgcagaaa gaggacatcc cacctgcaga cctcagtgac 3000
caagtcccgg acaccgagtc tgagaccaga attctcctgc aagggacccc agtggcccag 3060
atgacagagg atgccgtcga cgcggaacgg ctgaagcacc tcattgtgac cccctcgggc 3120
tgcggggaac agaacatgat cggcatgacg cccacggtca tcgctgtgca ttacctggat 3180
gaaacggagc agtgggagaa gttcggccta gagaagcggc agggggcctt ggagctcatc 3240
aagaaggggt acacccagca gctggccttc agacaaccca gctctgcctt tgcggccttc 3300
gtgaaacggg cacccagcac ctggctgacc gcctacgtgg tcaaggtctt ctctctggct 3360
gtcaacctca tcgccatcga ctcccaagtc ctctgcgggg ctgttaaatg gctgatcctg 3420
```

-continued gagaagcaga agcccgacgg ggtcttccag gaggatgcgc ccgtgataca ccaagaaatg 3480
attggtggat tacggaacaa caacgagaaa gacatggccc tcacggcctt tgttctcatc 3540
tcgctgcagg aggctaaaga tatttgcgag gagcaggtca acagcctgcc aggcagcatc 3600
actaaagcag gagacttcct tgaagccaac tacatgaacc tacagagatc ctacactgtg 3660
gccattgctg gctatgctct ggcccagatg ggcaggctga aggggcctct tcttaacaaa 3720
tttctgacca cagccaaaga taagaaccgc tgggaggacc ctggtaagca gctctacaac 3780
gtggaggcca catcctatgc cctcttggcc ctactgcagc taaaagactt tgactttgtg 3840
cctcccgtcg tgcgttggct caatgaacag agatactacg gtggtggcta tggctctacc 3900
caggccacct tcatggtgtt ccaagccttg gctcaatacc aaaaggacgc ccctgaccac 3960
caggaactga accttgatgt gtccctccaa ctgcccagcc gcagctccaa gatcacccac 4020
cgtatccact gggaatctgc cagcctcctg cgatcagaag agaccaagga aaatgagggt 4080
ttcacagtca cagctgaagg aaaaggccaa ggcaccttgt cggtggtgac aatgtaccat 4140
gctaaggcca aagatcaact cacctgtaat aaattcgacc tcaaggtcac cataaaacca 4200
gcaccggaaa cagaaaagag gcctcaggat gccaagaaca ctatgatcct tgagatctgt 4260
accaggtacc ggggagacca ggatgccact atgtctatat tggacatatc catgatgact 4320
ggctttgctc cagacacaga tgacctgaag cagctggcca atggtgttga cagatacatc 4380
tccaagtatg agctggacaa agccttctcc gataggaaca ccctcatcat ctacctggac 4440
aaggtctcac actctgagga tgactgtcta gctttcaaag ttcaccaata ctttaatgta 4500
gagcttatcc agcctggagc agtcaaggtc tacgcctatt acaacctgga ggaaagctgt 4560
acccggttct accatccgga aaaggaggat ggaaagctga acaagctctg ccgtgatgaa 4620
ctgtgccgct gtgctgagga gaattgcttc atacaaaagt cggatgacaa ggtcaccctg 4680
gaagaacggc tggacaaggc ctgtgagcca ggagtggact atgtgtacaa gacccgactg 4740
gtcaaggttc agctgtccaa tgactttgac gagtacatca tggccattga gcagaccatc 4800
aagtcaggct cggatgaggt gcaggttgga cagcagcgca cgttcatcag ccccatcaag 4860
tgcagagaag ccctgaagct ggaggagaag aaacactacc tcatgtgggg tctctcctcc 4920
gatttctggg gagagaagcc caacctcagc tacatcatcg ggaaggacac ttgggtggag 4980
cactggcccg aggaggacga atgccaagac gaagagaacc agaaacaatg ccaggacctc 5040
ggcgccttca ccgagagcat ggttgtcttt gggtgcccca actgaccaca cccccattcc 5100
cccactccag ataaagcttc agttatatct caaaaaaaaa aaaaaaaa 5148

<210> 2
<211> 5139
<212> DNA
<213> *Mus musculus*
<400> 2
agagaggaga gccatataaa gagccagcgg ctacagcccc agctcgcctc tgcccacccc 60
tgccccttac cccttcattc cttccacctt tttccttcac tatgggacca gcttcagggt 120
cccagctact agtgctactg ctgctgttgg ccagctcccc attagctctg gggatcccca 180
tgtattccat cattactccc aatgtcctac ggctggagag cgaagagacc atcgtactgg 240
aggcccacga tgctcagggt gacatcccag tcacagtcac tgtgcaagac ttcctaaaga 300
ggcaagtgct gaccagtgag aagacagtgt tgacaggagc cagtggacat ctgagaagcg 360
tctccatcaa gattccagcc agtaaggaat tcaactcaga taaggagggg cacaagtacg 420
tgacagtggt ggcaaacttc ggggaaacgg tggtggagaa agcagtgatg gtaagcttcc 480
agagtgggta cctcttcatc cagacagaca agaccatcta cacccctggc tccactgtct 540

-continued

```
tatatcggat cttcactgtg gacaacaacc tactgcccgt gggcaagaca gtcgtcatcc  600
tcattgagac ccccgatggc attcctgtca agagagacat tctgtcttcc aacaaccaac  660
acggcatctt gcctttgtct tggaacattc ctgaactggt caacatgggg cagtggaaga  720
tccgagcctt ttacgaacat gcgccgaagc agatcttctc cgcagagttt gaggtgaagg  780
aatacgtgct gcccagtttt gaggtccggg tggagcccac agagacattt tattacatcg  840
atgacccaaa tggcctggaa gtttccatca tagccaagtt cctgtacggg aaaaacgtgg  900
acgggacagc cttcgtgatt tttggggtcc aggatggcga taagaagatt tctctggccc  960
actccctcac gcgcgtagtg attgaggatg gtgtggggga tgcagtgctg acccggaagg 1020
tgctgatgga gggggtacgg ccttccaacg ccgacgccct ggtggggaag tccctgtatg 1080
tctccgtcac tgtcatcctg cactcaggta gtgacatggt agaggcagag cgcagtggga 1140
tcccgattgt cacttccccg taccagatcc acttcaccaa gacacccaaa ttcttcaagc 1200
cagccatgcc ctttgacctc atggtgttcg tgaccaaccc cgatggctct ccggccagca 1260
aagtgctggt ggtcactcag ggatctaatg caaaggctct cacccaagat gatggcgtgg 1320
ccaagctaag catcaacaca cccaacagcc gccaacccct gaccatcaca gtccgcacca 1380
agaaggacac tctcccagaa tcacggcagg ccaccaagac aatggaggcc catccctaca 1440
gcactatgca caactccaac aactacctac acttgtcagt gtcacgaatg gagctcaagc 1500
cgggggacaa cctcaatgtc aacttccacc tgcgcacaga cccaggccat gaggccaaga 1560
tccgatacta cacctacctg gttatgaaca aggggaagct cctgaaggca ggccgccagg 1620
ttcgggagcc tggccaggac ctggtggtct tgtccctgcc catcactcca gagtttattc 1680
cttcatttcg cctggtggct tactacaccc tgattggagc tagtggccag agggaggtgg 1740
tggctgactc tgtgtgggtg gatgtgaagg attcctgtat tggcacgctg gtggtgaagg 1800
gtgacccaag agataaccat ctcgcacctg ggcaacaaac gacactcagg attgaaggaa 1860
accagggggc ccgagtgggg ctagtggctg tggacaaggg agtgtttgtg ctgaacaaga 1920
agaacaaact cacacagagc aagatctggg atgtggtaga gaaggcagac attggctgca 1980
ccccaggcag tcggaagaac tatgctggtg tcttcatgga tgcaggcctg gccttcaaga 2040
caagccaagg actgcagact gaacagagag cagatcttga gtgcaccaag ccagcagccc 2100
gccgccgtcg ctcagtacag ttgatggaaa gaaggatgga caaagctggt cagtacactg 2160
acaagggtct tcggaagtgt tgtgaggatg gtatgcggga tatccctatg agatacagct 2220
gccagcgccg ggcacgcctc atcacccagg gcgagaactg cataaaggcc ttcatagact 2280
gctgcaacca catcaccaag ctgcgtgaac aacacagaag agaccacgtg ctgggcctgg 2340
ccaggagtga attggaggaa gacataattc cagaagaaga tattatctct agaagccact 2400
tcccacagag ctggttgtgg accatagaag agttgaaaga accagagaaa aatggaatct 2460
ctacgaaggt catgaacatc tttctcaaag attccatcac cacctgggag attctggcag 2520
tgagcttgtc agacaagaaa gggatctgtg tggcagaccc ctatgagatc agagtgatgc 2580
aggacttctt cattgacctg cggctgccct actctgtagt gcgcaacgaa caggtggaga 2640
tcagagctgt gctcttcaac taccgtgaac aggaggaact taaggtgagg gtggaactgt 2700
tgcataatcc agccttctgc agcatggcca ccgccaagaa tcgctacttc cagaccatca 2760
aaatccctcc caagtcctcg gtggctgtac cgtatgtcat tgtccccttg aagatcggcc 2820
aacaagaggt ggaggtcaag gctgctgtct tcaatcactt catcagtgat ggtgtcaaga 2880
agacactgaa ggtcgtgcca gaaggaatga gaatcaacaa aactgtggcc atccatacac 2940
tggacccaga gaagctcggt caagggggag tgcagaaggt ggatgtgcct gccgcagacc 3000
```

-continued

```
ttagcgacca agtgccagac acagactctg agaccagaat tatcctgcaa gggagcccgg 3060

tggttcagat ggctgaagat gctgtggacg gggagcggct gaaacacctg atcgtgaccc 3120

ccgcaggctg tggggaacag aacatgattg gcatgacacc aacagtcatt gcggtacact 3180

acctggacca gaccgaacag tgggagaagt tcggcataga gaagaggcaa gaggccctgg 3240

agctcatcaa gaaagggtac acccagcagc tggccttcaa acagcccagc tctgcctatg 3300

ctgccttcaa caaccggccc cccagcacct ggctgacagc ctacgtggtc aaggtcttct 3360

ctctagctgc caacctcatc gccatcgact ctcacgtcct gtgtggggct gttaaatggt 3420

tgattctgga gaaacagaag ccggatggtg tctttcagga ggatgggccc gtgattcacc 3480

aagaaatgat tggtggcttc cggaacgcca aggaggcaga tgtgtcactc acagccttcg 3540

tcctcatcgc actgcaggaa gccagggaca tctgtgaggg gcaggtcaat agccttcctg 3600

ggagcatcaa caaggcaggg gagtatattg aagccagtta catgaacctg cagagaccat 3660

acacagtggc cattgctggg tatgccctgg ccctgatgaa caaactggag gaaccttacc 3720

tcggcaagtt tctgaacaca gccaaagatc ggaaccgctg ggaggagcct gaccagcagc 3780

tctacaacgt agaggccaca tcctacgccc tcctggccct gctgctgctg aaagactttg 3840

actctgtgcc ccctgtagtg cgctggctca atgagcaaag atactacgga ggcggctatg 3900

gctccaccca ggctaccttc atggtattcc aagccttggc ccaatatcaa acagatgtcc 3960

ctgaccataa ggacttgaac atggatgtgt ccttccacct ccccagccgt agctctgcaa 4020

ccacgtttcg cctgctctgg gaaaatggca acctcctgcg atcggaagag accaagcaaa 4080

atgaggcctt ctctctaaca gccaaaggaa aaggccgagg cacattgtcg gtggtggcag 4140

tgtatcatgc caaactcaaa agcaaagtca cctgcaagaa gtttgacctc agggtcagca 4200

taagaccagc ccctgagaca gccaagaagc ccgaggaagc caagaatacc atgttccttg 4260

aaatctgcac caagtacttg ggagatgtgg acgccactat gtccatcctg gacatctcca 4320

tgatgactgg ctttgctcca gacacaaagg acctggaact gctggcctct ggagtagata 4380

gatacatctc caagtacgag atgaacaaag ccttctccaa caagaacacc ctcatcatct 4440

acctagaaaa gatttcacac accgaagaag actgcctgac cttcaaagtt caccagtact 4500

ttaatgtggg acttatccag cccgggtcgg tcaaggtcta ctcctattac aacctcgagg 4560

aatcatgcac ccggttctat catccagaga aggacgatgg gatgctcagc aagctgtgcc 4620

acagtgaaat gtgccggtgt gctgaagaga actgcttcat gcaacagtca caggagaaga4680

tcaacctgaa tgtccggcta gacaaggctt gtgagcccgg agtcgactat gtgtacaaga 4740

ccgagctaac caacatagag ctgttggatg attttgatga gtacaccatg accatccagc 4800

aggtcatcaa gtcaggctca gatgaggtgc aggcagggca gcaacgcaag ttcatcagcc 4860

acatcaagtg cagaaacgcc ctgaagctgc agaaagggaa gaagtacctc atgtggggcc 4920

tctcctctga cctctgggga gaaaagccca acaccagcta catcattggg aaggacacgt 4980

gggtggagca ctggcctgag gcagaagaat gccaggatca gaagtaccag aaacagtgcg 5040

aagaacttgg ggcattcaca gaatctatgg tggtttatgg ttgtcccaac tgactacagc 5100

ccagccctct aataaagctt cagttgtatt tcacccatc                       5139
```

```
<210> 3
<211> 5091
<212> DNA
<213> Rattus norvegicus
<400> 3
ctacccctta cccctcactc cttccacctt tgtcctttac catgggaccc acgtcagggt   60

cccagctact agtgctactg ctgctgttgg ccagctccct gctagctctg gggagcccca  120
```

-continued

```
tgtactccat cattactccc aatgtcctgc ggctggagag tgaagagact ttcatactag  180
aggcccatga tgctcagggt gatgtcccag tcactgtcac tgtgcaagac ttcctaaaga  240
agcaagtgct gaccagtgag aagacagtgt tgacaggagc cactggacat ctgaacaggg  300
tctccatcaa gattccagcc agtaaggaat tcaatgcaga taaggggcac aagtacgtga  360
cagtggtggc aaacttcggg gcaacagtgg tggagaaagc ggtgctagta agctttcaga  420
gtggttacct cttcatccag acagacaaga ccatctacac cccaggctcc actgttttct  480
atcggatctt cactgtggac aacaacctat tgcctgtggg caagacagtc gtcatcgtca  540
ttgagacccc ggacggcgtt cccatcaaga gagacattct atcttcccac aaccaatatg  600
gcatcttgcc tttgtcttgg aacattccag aactggtcaa catggggcag tggaagatcc  660
gagccttcta tgaacatgca ccaaagcaga ccttctctgc agagtttgag gtgaaggaat  720
acgtgctgcc cagtttcgaa gtcctggtgg agcctacaga gaaattttat tacatcgatg  780
acccaaaggg cctggaagtt tccatcacag ccagattcct gtatgggaag aacgtggacg  840
ggacagcttt cgtgatcttt ggggtccagg atgaggataa gaagatttct ctggcccagt  900
ccctcacccg cgtgctgatc gaggatggtt caggggaggc agtgctcagc cgaaaagtgc  960
tgatggacgg ggtacggccc tccagcccag aagccctagt ggggaagtcc ctgtacgtct 1020
ctgtcactgt tatcctgcac tcaggtagcg acatggtaga ggcagagcgc agtgggatcc 1080
caattgtcac ttccccgtac cagatccact tcaccaagac acccaaattc ttcaagccag 1140
ccatgccttt cgacctcatg gtgtttgtga ccaaccctga tggctctcca gcccgcagag 1200
tgccagtagt cactcaggga tccgacgcgc aggctctcac ccaggatgat ggtgtggcca 1260
agctgagcgt caacacaccc aacaaccgcc aacccctgac tatcacggtc cgcaccaaga 1320
aggagggtat cccggacgcg cggcaggcca ccaggacgat gcaggcccag ccctacagca 1380
ctatgcacaa ttccaacaac tacctgcact tgtcagtgtc tcgggtggag ctcaagcctg 1440
gggacaacct caatgtcaac ttccacctgc gcacggacgc tggccaagag gccaagatcc 1500
gatactacac ctatctggtt atgaacaagg ggaagttact gaaggcaggc cgtcaggttc 1560
gggagcctgg ccaggacctg gtggtcttgt cactgcccat cactccagaa tttatacctt 1620
ccttccgcct ggtggcttac tacaccctga ttggagctaa tggccaaagg gaggtggtgg 1680
ccgactcagt gtgggtggat gtgaaggact cctgtgtagg cacgctggtg gtgaaaggtg 1740
acccaagaga taaccgacag cccgcgcctg ggcatcaaac gacactaagg atcgagggga 1800
accagggggc ccgagtgggg ctagtggctg tggacaaggg ggtgtttgtg ctgaacaaga 1860
agaacaaact cacacagagc aagatctggg atgtagtaga gaaggcagac attggctgca 1920
ccccaggcag tgggaagaac tatgcgggtg tcttcatgga tgctggcctg accttcaaga 1980
caaaccaagg cctgcagact gatcagagag aagatcctga gtgcgccaag ccagctgccc 2040
gccgccgtcg ctcagtgcag ttgatggaaa ggaggatgga caaagctggt cagtacaccg 2100
acaagggtct gcggaagtgt tgtgaggatg gcatgcgtga tatccctatg aagtacagct 2160
gccagcgccg ggctcgcctc atcacccagg gcgagagctg cctgaaggcc ttcatggact 2220
gctgcaacta tatcaccaag cttcgtgagc agcacagaag agaccatgtg ctgggcctgg 2280
ccaggagtga tgtggatgaa gacataatcc cagaagaaga tattatctct agaagccact 2340
tcccagagag ctggttgtgg accatagaag agttgaaaga accagagaaa aatggaatct 2400
ctacgaaggt catgaacatc tttctcaaag attccatcac cacctgggag attctggcag 2460
tgagcttgtc cgacaagaaa gggatctgtg tggcagaccc ctatgagatc acagtgatgc 2520
```

-continued aggacttctt cattgacctg cgactgccct actctgtggt gcgcaatgaa caggtggaga 2580
tcagagctgt gctcttcaat taccgtgaac aggagaaact taaggtaagg gtggaactgt 2640
tgcataaccc agccttctgc agcatggcca ctgccaagaa gcggtactac cagaccatcg 2700
aaatccctcc caagtcctct gtggctgtgc cttatgtcat tgtcccttg aagatcggcc 2760
tccaggaggt ggaggtcaag gccgccgtct tcaaccactt catcagtgat ggtgtcaaga 2820
agatactgaa ggtcgtgcca gaaggaatga gagtcaacaa aactgtggct gtccgtacac 2880
tggatccaga acacctcggt caaggggggag tgcagaggga ggatgtacct gcagcagacc 2940
tcagtgacca agtgccagac acagattctg agaccagaat tctcctgcaa gggaccccgg 3000
tggctcagat ggccgaggac gctgtggacg gggagcggct gaaacacctg atcgtgaccc 3060
cctctggctg tggggagcag aacatgattg gcatgacacc cacggtcatt gcagtacact 3120
atctggatca gaccgaacag tgggagaaat tcggcctaga gaagaggcaa gaagctctgg 3180
agctcatcaa gaaagggtac acccagcagc tggctttcaa acagcccagc tctgcctatg 3240
ctgccttcaa caaccggcct cccagcacct ggctgacagc ctatgtggtc aaggtcttct 3300
ctctggctgc caacctcatc gccatcgact ctcaggtcct gtgtggggct gtcaaatggc 3360
tgattctgga gaaacagaag ccagatggtg tctttcagga ggacggacca gtgattcacc 3420
aagaaatgat tggtggcttc cggaacacca aggaggcaga tgtgtcgctt acagcctttg 3480
tcctcatcgc actgcaggaa gccagagata tctgtgaggg gcaggtcaac agccttcccg 3540
ggagcatcaa caaggcaggg gagtatcttg aagccagtta cctgaacctg cagagaccat 3600
acacagtagc cattgctggg tatgccctgg ccctgatgaa caaactggag gaaccttacc 3660
tcaccaagtt tctgaacaca gccaaagatc ggaaccgctg ggaggagcct ggccagcagc 3720
tctacaatgt ggaggccacc tcctacgccc tcctggccct gctgctgctg aaagactttg 3780
actctgtgcc tcctgtggtg cgctggctca acgagcaaag atactacgga ggtggctatg 3840
gctccacgca ggctaccttc atggtattcc aagccttggc tcaataccaa acagatgtcc 3900
ctgaccacaa ggacttgaac atggatgtgt ccctccacct ccccagccgc agctccccaa 3960
ctgtgtttcg cctgctatgg gaaagtggca gtctcctgag atcagaagag accaagcaga 4020
atgagggctt ttctctgaca gccaaaggaa aaggccaagg cacactgtcg gtggtgacag 4080
tgtatcacgc caaagtcaaa ggcaaagcca cctgcaagaa gtttgacctc agggtcacca 4140
taaaaccagc ccctgagaca gccaagaagc cccaggatgc caagagttct atgatccttg 4200
acatctgcac caggtacttg ggagacgtgg atgctactat gtccatcctg gacatctcca 4260
tgatgactgg ctttattcca gacacaaacg acctggaact gctgagctct ggagtagaca 4320
gatacatttc caagtatgag atggacaaag ccttctccaa caagaacacc ctcatcatct 4380
acctagaaaa gatctcacac tccgaagaag actgcctgtc cttcaaagtc caccagttct 4440
ttaacgtggg acttatccag ccggggtcgg tcaaggtcta ctcctactac aatctagagg 4500
agtcatgcac ccggttctat catccggaga aggacgatgg aatgctgagc aagctgtgcc 4560
acaatgaaat gtgccgctgt gcagaggaga actgcttcat gcatcagtca caggatcagg 4620
tcagcctgaa tgaacgacta gacaaggctt gtgagcctgg agtggactac gtgtacaaga 4680
ccaagctaac gacgatagag ctgtcggatg attttgatga gtacatcatg accatcgagc 4740
aggtcatcaa gtcaggctca gatgaggtgc aggcaggtca ggaacgaagg ttcatcagcc 4800
acgtcaagtg cagaaacgcc ctaaagctgc agaaagggaa gcagtacctc atgtggggcc 4860
tctcctccga cctctgggga gaaaagccca ataccagcta catcattggg aaggacacgt 4920
gggtggagca ctggcccgag gcagaggaat gtcaggatca gaagaaccag aaacagtgcg 4980

-continued aagacctcgg ggcattcaca gaaacaatgg tggttttcgg ctgccccaac tgaccacaac 5040
ctccaataaa gcttcagttg tattttaccc atcaaaaaaa aaaaaaaaaa a 5091

<210> 4
<211> 5126
<212> DNA
<213> *Macaca fascicularis*
<400> 4
aaagccaact ccagcagtca ctgctcactc ctccccatcc tctccctctg tccctctgtc 60
cctctgaccc tgcactgtcc cagcaccatg ggactcacct caggtcccag cctgctgctc 120
ctgctactaa tccacctccc cctggctctg ggactcccca tgtactctat gatcacccca 180
aacgtcttgc ggctggagag tgaggagacc gtggtgctgg aggcccatga cgcgaatggg 240
gatgttccgg tcactgtcac tgtccacgac ttcccaggca aaaaactggt gctgtccagt 300
gagaagaccg tgctgacccc tgccaccagc cacatgggca gcgtcaccat caggatccca 360
gccaacaagg agttcaagtc agaaaagggg cacaacaagt tcgtgactgt gcaggccacc 420
ttcggggccc aagtggtgga gaaggtggta ctggtcagcc ttcagagcgg gtacctcttc 480
atccagacag acaagaccat ctacacccct ggctccacag ttctctgtcg gatcttcacc 540
gtcaaccaca agctgctacc cgtgggccgg acggtcgtgg tcaacattga gaacccggac 600
ggcatcccgg tcaagcagga ctccttgtct tctcagaacc aatttggcat cttgcccttg 660
tcttgggaca ttccggaact cgtcaacatg ggccagtgga agatccgagc ctactatgaa 720
aattcgccgc aacaggtctt ctccactgag tttgaggtga aggagtacgt gctgcccagt 780
ttcgaggtca tagtggagcc tacagagaaa ttctactaca tctataacca gaagggcctg 840
gaggtcacca tcaccgccag gttcctctat ggaaagaaag tggagggaac tgcctttgtc 900
atcttcggga tccaggatgg cgagcagagg atttccctgc ctgaatccct caagcgcatc 960
cagattgagg atggctcagg agacgccgtg ctgagccgga aggtactgct ggacggggtg 1020
cagaatcccc gaccggaaga cctagtgggg aagtccttgt atgtgtctgt caccgttatc 1080
ctgcactcag gcagtgacat ggtgcaggcg gagcgcagcg ggatccccat cgtgacctct 1140
ccctaccaga tccacttcac caagacgccc aagtacttca aaccaggaat gccctttgac 1200
ctcatggtgt tcgtgacgaa ccccgatggc tctccagcct accgagtccc cgtggcagtc 1260
cagggcgagg acgctgtgca gtctctaacc cagggagacg gcgtggccaa actcagcatc 1320
aacacacacc ccagccagaa gcccttgagc atcacggtgc gcacgaagaa gcgggagctc 1380
tcggaggcgg agcaggctac caggaccatg gaggctcagc cctacagcac cgtgggcaac 1440
tccaacaatt acctgcatct ctcagtgcca cgtgcagagc tcagacctgg ggagaccctc 1500
aacgtcaact tcctcctgcg aatggaccgc acccaggagg ccaagatccg ctactacacc 1560
tacctgatta tgaacaaagg caagctgttg aaggtgggac gccaggtgcg agagcctggc 1620
caggacctgg tggtgctgcc cctgtccatc accaccgact tcatcccttc cttccgcctg 1680
gtggcctact acacgctgat cggcgccaac ggccagaggg aagtggtggc cgactccgtg 1740
tgggtggacg tcaaggactc ttgcgtgggc tcgctggtgg taaaaagcgg ccagtcagaa 1800
gacaggcagc ctttacccgg gcagcagatg accctgaaga tagagggtga ccacggggcc 1860
cgggtgggac tggtggctgt ggacaagggc gtgtttgtgc tgaataagaa gaacaagctg 1920
acgcagagta agatctggga cgtggtggag aaggcagaca tcggctgcac cccaggcagt 1980
gggaaggatt acgctggtgt cttctcggat gcaggcctga cctttgcgag cagcagtggc 2040
cagcagacgg cccagagggc agaacttcag tgcccacagc cagccgcccg ccgacgccgt 2100
tccgtgcagc tcgcggagaa gagaatggac aaagttggtc agtaccccaa ggagctgcgc 2160

-continued aagtgctgcg agcacggtat gcgggagaac cccatgaggt tctcatgcca gcgccggacc 2220
cgttacatca ccctggacga ggcgtgcaag aaggccttcc tggactgctg caactacatc 2280
accgagctgc ggcggcagca cgcgcgggcc agtcacctgg gcctggccag gagtaacctg 2340
gatgaggaca tcatcgcaga agagaacatc gtttcccgaa gtgagttccc agagagttgg 2400
ctgtggaaga ttgaagagtt gaaagaggca ccgaaaaacg gaatctccac gaagctcatg 2460
aatatatttt tgaaagactc catcaccacg tgggagattc tggccgtgag cttgtcagac 2520
aagaaaggga tctgtgtggc agacccctc gaggtcacag taatgcagga cttcttcatc 2580
gacctgcggc taccctactc tgttgttcga aacgagcagg tggaaatccg agctgttctc 2640
tacaattacc ggcagaacca agagctcaag gtgagggtgg aactactcca caatccagcc 2700
ttctgcagcc tggccaccgc caagaggcgt caccagcaga ccgtaaccat cccccccaag 2760
tcctcgctgt ccgttcctta tgtcatcgtg cccctaaaga ccggccagca ggaagtggaa 2820
gtcaaggctg ccgtctacca tttttcatc agtgacggtg tcaggaagtc cctgaaggtc 2880
gtgccggaag gaatcagaat gaacaaaact gtggctgttc gcacgctgga tccagaacgc 2940
ctgggccagg aaggagtgca gagagaggac gtcccacctg cagacctcag tgaccaagtc 3000
ccggacaccg agtctgagac cagaattctc ctgcaaggga ccccggtggc ccagatgaca 3060
gaggatgcca tcgatgcgga acggctgaag cacctcatcg tgacccctc gggctgcgga 3120 gaacagaaca tgatcaccat gacgcccaca gtcatcgctg tgcattacct ggatgaaacg 3180
gaacagtggg agaagttcgg cccggagaag cggcaggggg ccttggagct catcaagaag 3240
gggtacaccc agcagctggc cttcagacaa cccagctctg cctttgcggc cttcctgaac 3300
cgggcaccca gcacctggct gaccgcctac gtggtcaagg tcttctctct ggctgtcaac 3360
ctcattgcca tcgactccca ggtcctctgc ggggctgtta aatggctgat cctggagaag 3420
cagaagcccg acggggtctt ccaggaggat gcgcccgtga tacatcaaga aatgactggt 3480
ggattccgga acaccaacga gaaagacatg gccctcacgg cctttgttct catctcgctg 3540
caagaggcta aagagatttg cgaggagcag gtcaacagcc tgcccggcag catcactaaa 3600
gcaggagact tccttgaagc caactacatg aacctacaga gatcctacac tgtggccatc 3660
gctgcctatg ccctggccca gatgggcagg ctgaagggac ctcttctcaa caaatttctg 3720
accacagcca aagataagaa ccgctgggag gagcctggtc agcagctcta caatgtggag 3780
gccacatcct atgccctctt ggccctactg cagctaaaag actttgactt tgtgcctccc 3840
gtcgtgcgtt ggctcaatga acagagatac tacggtggtg gctatggctc tacccaggcc 3900
accttcatgg tgttccaagc cttggctcaa taccaaaagg atgtccctga tcacaaggaa 3960
ctgaacctgg atgtgtccct ccaactgccc agtcgcagct ccaagatcat ccaccgtatc 4020
cactgggaat ctgccagcct cctgcgatca gaagagacca aggaaaatga gggtttcaca 4080
gtcacagctg aaggaaaagg ccaaggcacc ttgtcggtag tgacaatgta ccatgctaag 4140
gccaaaggtc aactcacctg taataaattc gacctcaagg tcaccataaa accagcaccg 4200
gaaacagaaa agaggcctca ggatgccaag aacactatga tccttgagat ctgtaccagg 4260
taccggggag accaggatgc cactatgtct atactggaca tatccatgat gactggcttc 4320
gttccagaca cagatgacct caagcagctg gcaaacggcg ttgacagata catctccaag 4380
tatgagctgg acaaagcctt ctccgatagg aacaccctca tcatctacct ggacaaggtc 4440
tcacactctg aggatgactg tatagctttc aaagttcacc aatattttaa tgtagagctt 4500
atccagcctg gtgcagtcaa ggtctacgcc tattacaacc tggcggaaag ctgtacccgg 4560

-continued ttctaccacc cagaaaagga ggatggaaag ctgaacaagc tctgtcgtga tgagctgtgc 4620
cgctgtgctg aggagaattg cttcatacaa aagttggatg acaaagtcac cctggaagaa 4680
cggctggaca aggcctgtga gccaggagtg gactatgtgt acaagacccg actggtcaag 4740
gcccagctgt ccaatgactt tgacgagtac atcatggcca ttgagcagat catcaagtca 4800
ggctcggatg aggtgcaggt tggacaacag cgcacgttca tcagccccat caagtgcagg 4860
gaagccctga agctggagga gaggaaacac tacctcatgt ggggtctctc ctccgatttc 4920
tggggagaga aacccaatct cagctacatc atcgggaagg acacctgggt ggagcactgg 4980
cccgaggagg acgaatgcca agatgaagag aaccagaaac aatgccagga cctcggcacc 5040
ttcactgaga acatggttgt ctttgggtgc cccaactgac cacacccccca ttcccccact 5100 cccaataaag cttcagttat atttca 5126

<210> 5
<211> 5148
<212> DNA
<213> *Homo sapiens*
<400> 5
tttttttttt tttttttgag atataactga agctttatct ggagtggggg aatgggggtg 60
tggtcagttg gggcacccaa agacaaccat gctctcggtg aaggcgccga ggtcctggca 120
ttgtttctgg ttctcttcgt cttggcattc gtcctcctcg ggccagtgct ccacccaagt 180
gtccttcccg atgatgtagc tgaggttggg cttctctccc cagaaatcgg aggagagacc 240
ccacatgagg tagtgtttct tctcctccag cttcagggct tctctgcact tgatggggct 300
gatgaacgtg cgctgctgtc caacctgcac ctcatccgag cctgacttga tggtctgctc 360
aatggccatg atgtactcgt caaagtcatt ggacagctga accttgacca gtcgggtctt 420
gtacacatag tccactcctg gctcacaggc cttgtccagc cgttcttcca gggtgacctt 480
gtcatccgac ttttgtatga agcaattctc ctcagcacag cggcacagtt catcacggca 540
gagcttgttc agctttccat cctccttttc cggatggtag aaccgggtac agctttcctc 600
caggttgtaa taggcgtaga ccttgactgc tccaggctgg ataagctcta cattaaagta 660
ttggtgaact ttgaaagcta gacagtcatc ctcagagtgt gagaccttgt ccaggtagat 720
gatgagggtg ttcctatcgg agaaggcttt gtccagctca tacttggaga tgtatctgtc 780
aacaccattg gccagctgct tcaggtcatc tgtgtctgga gcaaagccag tcatcatgga 840
tatgtccaat atagacatag tggcatcctg gtctccccgg tacctggtac agatctcaag 900
gatcatagtg ttcttggcat cctgaggcct cttttctgtt tccggtgctg gttttatggt 960
gaccttgagg tcgaatttat tacaggtgag ttgatctttg gccttagcat ggtacattgt 1020
caccaccgac aaggtgcctt ggccttttcc ttcagctgtg actgtgaaac cctcattttc 1080
cttggtctct tctgatcgca ggaggctggc agattcccag tggatacggt gggtgatctt 1140
ggagctgcgg ctgggcagtt ggagggacac atcaaggttc agttcctggt ggtcaggggc 1200
gtccttttgg tattgagcca aggcttggaa caccatgaag gtggcctggg tagagccata 1260
gccaccaccg tagtatctct gttcattgag ccaacgcacg acgggaggca caaagtcaaa 1320
gtcttttagc tgcagtaggg ccaagagggc ataggatgtg gcctccacgt tgtagagctg 1380
cttaccaggg tcctcccagc ggttcttatc tttggctgtg gtcagaaatt tgttaagaag 1440
aggccccttc agcctgccca tctgggccag agcatagcca gcaatggcca cagtgtagga 1500
tctctgtagg ttcatgtagt tggcttcaag gaagtctcct gctttagtga tgctgcctgg 1560
caggctgttg acctgctcct cgcaaatatc tttagcctcc tgcagcgaga tgagaacaaa 1620
ggccgtgagg gccatgtctt tctcgttgtt gttccgtaat ccaccaatca tttcttggtg 1680

-continued

```
tatcacgggc gcatcctcct ggaagacccc gtcgggcttc tgcttctcca ggatcagcca 1740
tttaacagcc ccgcagagga cttgggagtc gatggcgatg aggttgacag ccagagagaa 1800
gaccttgacc acgtaggcgg tcagccaggt gctgggtgcc cgtttcacga aggccgcaaa 1860
ggcagagctg ggttgtctga aggccagctg ctgggtgtac cccttcttga tgagctccaa 1920
ggcccccctgc cgcttctcta ggccgaactt ctcccactgc tccgtttcat ccaggtaatg 1980
cacagcgatg accgtgggcg tcatgccgat catgttctgt tccccgcagc ccgagggggt 2040
cacaatgagg tgcttcagcc gttccgcgtc gacggcatcc tctgtcatct gggccactgg 2100
ggtcccttgc aggagaattc tggtctcaga ctcggtgtcc gggacttggt cactgaggtc 2160
tgcaggtggg atgtcctctt tctgcactcc ttcacggccc aggcgttctg gatccagggt 2220
gcgaacagcc acagttttgt tcattctgat tccttccggc acgaccttca gggacttcct 2280
gacaccgtca ctgatgaaat gatggtagac agcagccttg acttccactt cctgcaggcc 2340
ggtctttagc ggcacgatga catatggaac ggacaacgag gacttggggg ggatggttac 2400
ggtctgctgg tgacgcctct tggtggtggc caggctgcag aaggctggat tgtggagtag 2460
ttccaccctc accttgagct cttggttctg ccggtaattg tagagaacgg ctcggatttc 2520
cacctgctcg tttcgaacaa cagagtaggg tagccgcagg tcgatgaaga agtcctgcat 2580
tactgtgacc tcgaaggggt ctgccacaca gatccctttc ttgtccgaca tgctcacagc 2640
cagaatctcc cacgtggtga tggagtcttt caaaaatata ttcatgagct tcgtagagat 2700
tccatttttc ggtggctctt tcaagtcctc aacgttccac agccagctct ctgggaactc 2760
acttcgggaa acgatgttct cttctgcaat gatgtcctca tccaggttac tcctggccag 2820
gcccaggtgg ctggcccgcg cgtgctgccg ccgcagctct gtgatgtagt tgcagcagtc 2880
caggaagacc ttcttgcacg cctcgcccag ggagatgaaa cgggtccggc gctggcacga 2940
gaacctcatg ggttctcccc gcatgccgtc ctcgcagcac ttgcgcagct ccttggggta 3000
cttgccgact ttgtccattc gcttctccgt gagctgcacg gaacggcgtc ggcgggcggc 3060
tggctgcggg cactgaagtt ctgccctctg ggcggtctgc tggccactgc tgctcgtgaa 3120
ggtcagccct gcgtcggaga agacaccggc gtaatccttc ccactgcccg gggtgcagcc 3180
gatgtctgcc ttctccacca cgtcccagat cttactctgc gtcagtttgt tcttcttatt 3240
cagcacgaac acgcccttgt ccacggccac cagtaccacc cgggccccgt ggtcaccctc 3300
tatcttcagg gtcatctgct gcccaggtac aggctgccgg tcttctgact ggccgctttt 3360
taccaccagc gagcccacgc aggagtcctt gacgtccacc cacacggagt cggccaccac 3420
ctccctctgg ccgctggcac cgatcagcgt gtagtacgcc accaggcgga aggaagggat 3480
gaagtcggtg gtgatggaca ggggcagcac caccaggtcc tggccgggct ctcgcacctg 3540
gcgtcccgcc ttcaacagcc tgcccttgtt catgatcagg taggtgtagt agcggatctt 3600
ggcctcgtgg gcgcggtcca ttcgcaggag gaagttgacg ttgagggtct ccccgggtct 3660
gagctctgta cgtagcactg agagatgcag gtaattgttg gagttgccca cggtgctgta 3720
gggcagagcc tgcatggtcc tggtagcctg ctctgcctcc gagagctcct gcttcttcgt 3780
gcgcaccgtg atgctcaagg gcttctggct ggggtgtgtg ttgatgctga gtttggccac 3840
gccatctccc tgggttagag actgcacagt gtcctcgccc tggactgcca cggggactcg 3900
gtaggctgga gagccatcag ggttcgtcac gaacaccatg aggtcaaagg gcattcctgg 3960
tttgaagtac ttgggtgtct tggtgaagtg gatctggtag ggagaggtca cgatggggat 4020
cccgctgcgc tctgcctgca ccatgtcact gcctgagtgc aagatgacgg tggcagacac 4080
gtacaaagac ttccccacca ggtcttctgc tcgggggttc tgcaccccgt ccagcagtac 4140
```

-continued cttccggctc agcacaacct cccccgagcc atcctcaatc ggaatgcgct tgagggattc 4200
aggcagggaa atcctctgtt cgccatcctg gatcccgaag atgacaaagg cagttccctc 4260
cactttcttc ccgtagagga acctggcggt gatggtgacc tccaggccct tctcgttata 4320
gatgtagtag aatttctctg taggctccac tatgacctcg aaactgggca gcacgtactc 4380
cttcacctca aactcagtgg agaagacctg ctgtggtgag ttttcatagt aggctcggat 4440
cttccactgg cccatgttga cgagttccgg aatgtcccaa gacaagggca agacgccaag 4500
ctggttctga gaagacaagg agtcctgctt gaccgggatg ccttccgggt tctcaatgtt 4560
gaccatgacc gtccggccca cgggtagcag cttgtggttg acggtgaaga tccgatagag 4620
aactgtggag ccaggggtgt agatggtctt gtctgtctgg atgaagaggt acccgctctg 4680
caggctgacc agcaccacct tctccaccac ttgggtcccg aaggtggcct gcacggtcac 4740
gaacttgttg cgcccctttt ctgacttgaa ctccctgttg gctgggatcg tgaaggtgac 4800
gttgcccatg tggttggtgg caggggtcag cacagtcttc tcactggaca gcactagttt 4860
tttgcctggg aagtcgtgga cagtaacagt gactggaaca tccccttgcg cgtcgtgggc 4920
ctccagcacc atggtctcct cgctctccag ccgcaagatg ttgggggtga tgatagagta 4980
catgggactc cccagagcca gggggaggtg ggttagtagc aggagcagca ggctgggacc 5040
tgaggtgggt cccatggtgc tgggacagtg cagggtcaga gggacagagg gacagaggga 5100
gaggatgggg aggagtgagc agcgcctgct ggagctggct ttttatct 5148

<210> 6
<211> 5139
<212> DNA
<213> *Mus musculus*
<400> 6
gatgggtgaa atacaactga agctttatta gagggctggg ctgtagtcag ttgggacaac 60
cataaaccac catagattct gtgaatgccc caagttcttc gcactgtttc tggtacttct 120
gatcctggca ttcttctgcc tcaggccagt gctccaccca cgtgtccttc ccaatgatgt 180
agctggtgtt gggcttttct ccccagaggt cagaggagag gccccacatg aggtacttct 240
tccctttctg cagcttcagg gcgtttctgc acttgatgtg gctgatgaac ttgcgttgct 300
gccctgcctg cacctcatct gagcctgact tgatgacctg ctggatggtc atggtgtact 360
catcaaaatc atccaacagc tctatgttgg ttagctcggt cttgtacaca tagtcgactc 420
cgggctcaca agccttgtct agccggacat tcaggttgat cttctcctgt gactgttgca 480
tgaagcagtt ctcttcagca caccggcaca tttcactgtg gcacagcttg ctgagcatcc 540
catcgtcctt ctctggatga tagaaccggg tgcatgattc ctcgaggttg taataggagt 600
agaccttgac cgacccgggc tggataagtc ccacattaaa gtactggtga actttgaagg 660
tcaggcagtc ttcttcggtg tgtgaaatct tttctaggta gatgatgagg gtgttcttgt 720
tggagaaggc tttgttcatc tcgtacttgg agatgtatct atctactcca gaggccagca 780
gttccaggtc ctttgtgtct ggagcaaagc cagtcatcat ggagatgtcc aggatggaca 840
tagtggcgtc cacatctccc aagtacttgg tgcagatttc aaggaacatg gtattcttgg 900
cttcctcggg cttcttggct gtctcagggg ctggtcttat gctgaccctg aggtcaaact 960
tcttgcaggt gactttgctt ttgagtttgg catgatacac tgccaccacc gacaatgtgc 1020
ctcggccttt tcctttggct gttagagaga aggcctcatt ttgcttggtc tcttccgatc 1080
gcaggaggtt gccattttcc cagagcaggc gaaacgtggt tgcagagcta cggctgggga 1140
ggtggaagga cacatccatg ttcaagtcct tatggtcagg gacatctgtt tgatattggg 1200
ccaaggcttg gaataccatg aaggtagcct gggtggagcc atagccgcct ccgtagtatc 1260

-continued

```
tttgctcatt gagccagcgc actacagggg gcacagagtc aaagtctttc agcagcagca 1320
gggccaggag ggcgtaggat gtggcctcta cgttgtagag ctgctggtca ggctcctccc 1380
agcggttccg atctttggct gtgttcagaa acttgccgag gtaaggttcc tccagtttgt 1440
tcatcagggc cagggcatac ccagcaatgg ccactgtgta tggtctctgc aggttcatgt 1500
aactggcttc aatatactcc cctgccttgt tgatgctccc aggaaggcta ttgacctgcc 1560
cctcacagat gtccctggct tcctgcagtg cgatgaggac gaaggctgtg agtgacacat 1620
ctgcctcctt ggcgttccgg aagccaccaa tcatttcttg gtgaatcacg ggcccatcct 1680
cctgaaagac accatccggc ttctgtttct ccagaatcaa ccatttaaca gccccacaca 1740
ggacgtgaga gtcgatggcg atgaggttgg cagctagaga gaagaccttg accacgtagg 1800
ctgtcagcca ggtgctgggg ggccggttgt tgaaggcagc ataggcagag ctgggctgtt 1860
tgaaggccag ctgctgggtg taccctttct tgatgagctc cagggcctct tgcctcttct 1920
ctatgccgaa cttctcccac tgttcggtct ggtccaggta gtgtaccgca atgactgttg 1980
gtgtcatgcc aatcatgttc tgttccccac agcctgcggg ggtcacgatc aggtgtttca 2040
gccgctcccc gtccacagca tcttcagcca tctgaaccac cgggctccct tgcaggataa 2100
ttctggtctc agagtctgtg tctggcactt ggtcgctaag gtctgcggca ggcacatcca 2160
ccttctgcac tccccccttga ccgagcttct ctgggtccag tgtatggatg gccacagttt 2220
tgttgattct cattccttct ggcacgacct tcagtgtctt cttgacacca tcactgatga 2280
agtgattgaa gacagcagcc ttgacctcca cctcttgttg gccgatcttc aaggggacaa 2340
tgacatacgg tacagccacc gaggacttgg gagggatttt gatggtctgg aagtagcgat 2400
tcttggcggt ggccatgctg cagaaggctg gattatgcaa cagttccacc ctcaccttaa 2460
gttcctcctg ttcacggtag ttgaagagca cagctctgat ctccacctgt tcgttgcgca 2520
ctacagagta gggcagccgc aggtcaatga agaagtcctg catcactctg atctcatagg 2580
ggtctgccac acagatccct ttcttgtctg acaagctcac tgccagaatc tcccaggtgg 2640
tgatggaatc tttgagaaag atgttcatga ccttcgtaga gattccattt ttctctggtt 2700
ctttcaactc ttctatggtc cacaaccagc tctgtgggaa gtggcttcta gagataatat 2760
cttcttctgg aattatgtct tcctccaatt cactcctggc caggcccagc acgtggtctc 2820
ttctgtgttg ttcacgcagc ttggtgatgt ggttgcagca gtctatgaag gcctttatgc 2880
agttctcgcc ctgggtgatg aggcgtgccc ggcgctggca gctgtatctc atagggatat 2940
cccgcatacc atcctcacaa cacttccgaa gacccttgtc agtgtactga ccagctttgt 3000
ccatccttct ttccatcaac tgtactgagc gacggcggcg ggctgctggc ttggtgcact 3060
caagatctgc tctctgttca gtctgcagtc cttggcttgt cttgaaggcc aggcctgcat 3120
ccatgaagac accagcatag ttcttcccac tgcctggggt gcagccaatg tctgccttct 3180
ctaccacatc ccagatcttg ctctgtgtga gtttgttctt cttgttcagc acaaacactc 3240
ccttgtccac agccactagc cccactcggg ccccctggtt tccttcaatc ctgagtgtcg 3300
tttgttgccc aggtgcgaga tggttatctc ttgggtcacc cttcaccacc agcgtgccaa 3360
tacaggaatc cttcacatcc acccacacag agtcagccac cacctccctc tggccactag 3420
ctccaatcag ggtgtagtaa gccaccaggc gaaatgaagg aataaactct ggagtgatgg 3480
gcagggacaa gaccaccagg tcctggccag gctcccgaac ctggcggcct gccttcagga 3540
gcttcccctt gttcataacc aggtaggtgt agtatcggat cttggcctca tggcctgggt 3600
ctgtgcgcag gtggaagttg acattgaggt tgtcccccgg cttgagctcc attcgtgaca 3660
```

-continued

```
ctgacaagtg taggtagttg ttggagttgt gcatagtgct gtagggatgg gcctccattg 3720

tcttggtggc ctgccgtgat tctgggagag tgtccttctt ggtgcggact gtgatggtca 3780

ggggttggcg gctgttgggt gtgttgatgc ttagcttggc cacgccatca tcttgggtga 3840

gagcctttgc attagatccc tgagtgacca ccagcacttt gctggccgga gagccatcgg 3900

ggttggtcac gaacaccatg aggtcaaagg gcatggctgg cttgaagaat ttgggtgtct 3960

tggtgaagtg gatctggtac ggggaagtga caatcgggat cccactgcgc tctgcctcta 4020

ccatgtcact acctgagtgc aggatgacag tgacggagac atacagggac ttccccacca 4080

gggcgtcggc gttggaaggc cgtacccccct ccatcagcac cttccgggtc agcactgcat 4140

cccccacacc atcctcaatc actacgcgcg tgagggagtg ggccagagaa atcttcttat 4200

cgccatcctg gaccccaaaa atcacgaagg ctgtcccgtc cacgtttttc ccgtacagga 4260

acttggctat gatggaaact tccaggccat ttgggtcatc gatgtaataa aatgtctctg 4320

tgggctccac ccggacctca aaactgggca gcacgtattc cttcacctca aactctgcgg 4380

agaagatctg cttcggcgca tgttcgtaaa aggctcggat cttccactgc cccatgttga 4440

ccagttcagg aatgttccaa gacaaaggca agatgccgtg ttggttgttg gaagacagaa 4500

tgtctctctt gacaggaatg ccatcggggg tctcaatgag gatgacgact gtcttgccca 4560

cgggcagtag gttgttgtcc acagtgaaga tccgatataa gacagtggag ccaggggtgt 4620

agatggtctt gtctgtctgg atgaagaggt acccactctg gaagcttacc atcactgctt 4680

tctccaccac cgtttccccg aagtttgcca ccactgtcac gtacttgtgc ccctccttat 4740

ctgagttgaa ttccttactg gctggaatct tgatggagac gcttctcaga tgtccactgg 4800

ctcctgtcaa cactgtcttc tcactggtca gcacttgcct ctttaggaag tcttgcacag 4860

tgactgtgac tgggatgtca ccctgagcat cgtgggcctc cagtacgatg gtctcttcgc 4920

tctccagccg taggacattg ggagtaatga tggaatacat ggggatcccc agagctaatg 4980

gggagctggc caacagcagc agtagcacta gtagctggga ccctgaagct ggtcccatag 5040

tgaaggaaaa aggtggaagg aatgaagggg taaggggcag gggtgggcag aggcgagctg 5100

gggctgtagc cgctggctct ttatatggct ctcctctct                       5139
```

<210> 7
<211> 5091
<212> DNA
<213> *Rattus norvegicus*
<400> 7

```
tttttttttt tttttttga tgggtaaaat acaactgaag ctttattgga ggttgtggtc   60

agttggggca gccgaaaacc accattgttt ctgtgaatgc cccgaggtct tcgcactgtt  120

tctggttctt ctgatcctga cattcctctg cctcgggcca gtgctccacc cacgtgtcct  180

tcccaatgat gtagctggta ttgggctttt ctccccagag gtcggaggag aggccccaca  240

tgaggtactg cttccctttc tgcagcttta gggcgtttct gcacttgacg tggctgatga  300

accttcgttc ctgacctgcc tgcacctcat ctgagcctga cttgatgacc tgctcgatgg  360

tcatgatgta ctcatcaaaa tcatccgaca gctctatcgt cgttagcttg gtcttgtaca  420

cgtagtccac tccaggctca caagccttgt ctagtcgttc attcaggctg acctgatcct  480

gtgactgatg catgaagcag ttctcctctg cacagcggca catttcattg tggcacagct  540

tgctcagcat tccatcgtcc ttctccggat gatagaaccg ggtgcatgac tcctctagat  600

tgtagtagga gtagaccttg accgaccccg gctggataag tcccacgtta aagaactggt  660

ggactttgaa ggacaggcag tcttcttcgg agtgtgagat cttttctagg tagatgatga  720

gggtgttctt gttggagaag gctttgtcca tctcatactt ggaaatgtat ctgtctactc  780
```

-continued

```
cagagctcag cagttccagg tcgtttgtgt ctggaataaa gccagtcatc atggagatgt  840
ccaggatgga catagtagca tccacgtctc ccaagtacct ggtgcagatg tcaaggatca  900
tagaactctt ggcatcctgg ggcttcttgg ctgtctcagg ggctggtttt atggtgaccc  960
tgaggtcaaa cttcttgcag gtggctttgc ctttgacttt ggcgtgatac actgtcacca 1020
ccgacagtgt gccttggcct tttcctttgg ctgtcagaga aaagccctca ttctgcttgg 1080
tctcttctga tctcaggaga ctgccacttt cccatagcag gcgaaacaca gttggggagc 1140
tgcggctggg gaggtggagg gacacatcca tgttcaagtc cttgtggtca gggacatctg 1200
tttggtattg agccaaggct tggaatacca tgaaggtagc ctgcgtggag ccatagccac 1260
ctccgtagta tctttgctcg ttgagccagc gcaccacagg aggcacagag tcaaagtctt 1320
tcagcagcag cagggccagg agggcgtagg aggtggcctc cacattgtag agctgctggc 1380
caggctcctc ccagcggttc cgatctttgg ctgtgttcag aaacttggtg aggtaaggtt 1440
cctccagttt gttcatcagg gccagggcat acccagcaat ggctactgtg tatggtctct 1500
gcaggttcag gtaactggct tcaagatact cccctgcctt gttgatgctc ccgggaaggc 1560
tgttgacctg cccctcacag atatctctgg cttcctgcag tgcgatgagg acaaaggctg 1620
taagcgacac atctgcctcc ttggtgttcc ggaagccacc aatcatttct tggtgaatca 1680
ctggtccgtc ctcctgaaag acaccatctg gcttctgttt ctccagaatc agccatttga 1740
cagccccaca caggacctga gagtcgatgg cgatgaggtt ggcagccaga gagaagacct 1800
tgaccacata ggctgtcagc caggtgctgg gaggccggtt gttgaaggca gcataggcag 1860
agctgggctg tttgaaagcc agctgctggg tgtacccttt cttgatgagc tccagagctt 1920
cttgcctctt ctctaggccg aatttctccc actgttcggt ctgatccaga tagtgtactg 1980
caatgaccgt gggtgtcatg ccaatcatgt tctgctcccc acagccagag gggtcacga 2040
tcaggtgttt cagccgctcc ccgtccacag cgtcctcggc catctgagcc accggggtcc 2100
cttgcaggag aattctggtc tcagaatctg tgtctggcac ttggtcactg aggtctgctg 2160
caggtacatc ctccctctgc actcccctt gaccgaggtg ttctggatcc agtgtacgga 2220
cagccacagt tttgttgact ctcattcctt ctggcacgac cttcagtatc ttcttgacac 2280
catcactgat gaagtggttg aagacggcgg ccttgacctc cacctcctgg aggccgatct 2340
tcaaggggac aatgacataa ggcacagcca cagaggactt gggagggatt tcgatggtct 2400
ggtagtaccg cttcttggca gtggccatgc tgcagaaggc tgggttatgc aacagttcca 2460
cccttacctt aagtttctcc tgttcacggt aattgaagag cacagctctg atctccacct 2520
gttcattgcg caccacagag tagggcagtc gcaggtcaat gaagaagtcc tgcatcactg 2580
tgatctcata ggggtctgcc acacagatcc ctttcttgtc ggacaagctc actgccagaa 2640
tctcccaggt ggtgatggaa tctttgagaa agatgttcat gaccttcgta gagattccat 2700
ttttctctgg ttctttcaac tcttctatgg tccacaacca gctctctggg aagtggcttc 2760
tagagataat atcttcttct gggattatgt cttcatccac atcactcctg gccaggccca 2820
gcacatggtc tcttctgtgc tgctcacgaa gcttggtgat atagttgcag cagtccatga 2880
aggccttcag gcagctctcg ccctgggtga tgaggcgagc ccggcgctgg cagctgtact 2940
tcatagggat atcacgcatg ccatcctcac aacacttccg cagacccttg tcggtgtact 3000
gaccagcttt gtccatcctc ctttccatca actgcactga gcgacggcgg cgggcagctg 3060
gcttggcgca ctcaggatct tctctctgat cagtctgcag gccttggttt gtcttgaagg 3120
tcaggccagc atccatgaag acacccgcat agttcttccc actgcctggg gtgcagccaa 3180
tgtctgcctt ctctactaca tcccagatct tgctctgtgt gagtttgttc ttcttgttca 3240
```

-continued gcacaaacac ccccttgtcc acagccacta gccccactcg ggccccctgg ttcccctcga 3300
tccttagtgt cgtttgatgc ccaggcgcgg gctgtcggtt atctcttggg tcacctttca 3360
ccaccagcgt gcctacacag gagtccttca catccaccca cactgagtcg gccaccacct 3420
ccctttggcc attagctcca atcagggtgt agtaagccac caggcggaag gaaggtataa 3480
attctggagt gatgggcagt gacaagacca ccaggtcctg gccaggctcc cgaacctgac 3540
ggcctgcctt cagtaacttc cccttgttca taaccagata ggtgtagtat cggatcttgg 3600
cctcttggcc agcgtccgtg cgcaggtgga agttgacatt gaggttgtcc ccaggcttga 3660
gctccacccg agacactgac aagtgcaggt agttgttgga attgtgcata gtgctgtagg 3720
gctgggcctg catcgtcctg gtggcctgcc gcgcgtccgg gataccctcc ttcttggtgc 3780
ggaccgtgat agtcaggggt tggcggttgt tgggtgtgtt gacgctcagc ttggccacac 3840
catcatcctg ggtgagagcc tgcgcgtcgg atccctgagt gactactggc actctgcggg 3900
ctggagagcc atcagggttg gtcacaaaca ccatgaggtc gaaaggcatg gctggcttga 3960
agaatttggg tgtcttggtg aagtggatct ggtacgggga agtgacaatt gggatcccac 4020
tgcgctctgc ctctaccatg tcgctacctg agtgcaggat aacagtgaca gagacgtaca 4080
gggacttccc cactagggct tctgggctgg agggccgtac cccgtccatc agcacttttc 4140
ggctgagcac tgcctcccct gaaccatcct cgatcagcac gcgggtgagg gactgggcca 4200
gagaaatctt cttatcctca tcctggaccc caaagatcac gaaagctgtc ccgtccacgt 4260
tcttcccata caggaatctg gctgtgatgg aaacttccag gccctttggg tcatcgatgt 4320
aataaaattt ctctgtaggc tccaccagga cttcgaaact gggcagcacg tattccttca 4380
cctcaaactc tgcagagaag gtctgctttg gtgcatgttc atagaaggct cggatcttcc 4440
actgccccat gttgaccagt tctggaatgt tccaagacaa aggcaagatg ccatattggt 4500
tgtgggaaga tagaatgtct ctcttgatgg gaacgccgtc cggggtctca atgacgatga 4560
cgactgtctt gcccacaggc aataggttgt tgtccacagt gaagatccga tagaaaacag 4620
tggagcctgg ggtgtagatg gtcttgtctg tctggatgaa gaggtaacca ctctgaaagc 4680
ttactagcac cgctttctcc accactgttg ccccgaagtt tgccaccact gtcacgtact 4740
tgtgcccctt atctgcattg aattccttac tggctggaat cttgatggag accctgttca 4800
gatgtccagt ggctcctgtc aacactgtct tctcactggt cagcacttgc ttctttagga 4860
agtcttgcac agtgacagtg actgggacat caccctgagc atcatgggcc tctagtatga 4920
aagtctcttc actctccagc cgcaggacat tgggagtaat gatggagtac atggggctcc 4980
ccagagctag cagggagctg gccaacagca gcagtagcac tagtagctgg gaccctgacg 5040
tgggtcccat ggtaaaggac aaaggtggaa ggagtgaggg gtaaggggta g 5091

<210> 8
<211> 5126
<212> DNA
<213> *Macaca fascicularis*
<400> 8
tgaaatataa ctgaagcttt attgggagtg ggggaatggg ggtgtggtca gttggggcac 60
ccaaagacaa ccatgttctc agtgaaggtg ccgaggtcct ggcattgttt ctggttctct 120
tcatcttggc attcgtcctc ctcgggccag tgctccaccc aggtgtcctt cccgatgatg 180
tagctgagat tgggtttctc tccccagaaa tcggaggaga gaccccacat gaggtagtgt 240
ttcctctcct ccagcttcag ggcttccctg cacttgatgg ggctgatgaa cgtgcgctgt 300
tgtccaacct gcacctcatc cgagcctgac ttgatgatct gctcaatggc catgatgtac 360
tcgtcaaagt cattggacag ctgggccttg accagtcggg tcttgtacac atagtccact 420

-continued

```
cctggctcac aggccttgtc cagccgttct tccagggtga ctttgtcatc caacttttgt  480
atgaagcaat tctcctcagc acagcggcac agctcatcac gacagagctt gttcagcttt  540
ccatcctcct tttctgggtg gtagaaccgg gtacagcttt ccgccaggtt gtaataggcg  600
tagaccttga ctgcaccagg ctggataagc tctacattaa aatattggtg aactttgaaa  660
gctatacagt catcctcaga gtgtgagacc ttgtccaggt agatgatgag ggtgttccta  720
tcggagaagg ctttgtccag ctcatacttg gagatgtatc tgtcaacgcc gtttgccagc  780
tgcttgaggt catctgtgtc tggaacgaag ccagtcatca tggatatgtc cagtatagac  840
atagtggcat cctggtctcc ccggtacctg gtacagatct caaggatcat agtgttcttg  900
gcatcctgag gcctcttttc tgtttccggt gctggtttta tggtgacctt gaggtcgaat  960
ttattacagg tgagttgacc tttggcctta gcatggtaca ttgtcactac cgacaaggtg 1020
ccttggcctt ttccttcagc tgtgactgtg aaaccctcat tttccttggt ctcttctgat 1080
cgcaggaggc tggcagattc ccagtggata cggtggatga tcttggagct gcgactgggc 1140
agttggaggg acacatccag gttcagttcc ttgtgatcag ggacatcctt ttggtattga 1200
gccaaggctt ggaacaccat gaaggtggcc tgggtagagc catagccacc accgtagtat 1260
ctctgttcat tgagccaacg cacgacggga ggcacaaagt caaagtcttt tagctgcagt 1320
agggccaaga gggcatagga tgtggcctcc acattgtaga gctgctgacc aggctcctcc 1380
cagcggttct tatctttggc tgtggtcaga aatttgttga gaagaggtcc cttcagcctg 1440
cccatctggg ccagggcata ggcagcgatg gccacagtgt aggatctctg taggttcatg 1500
tagttggctt caaggaagtc tcctgcttta gtgatgctgc cgggcaggct gttgacctgc 1560
tcctcgcaaa tctctttagc ctcttgcagc gagatgagaa caaaggccgt gagggccatg 1620
tctttctcgt tggtgttccg gaatccacca gtcatttctt gatgtatcac gggcgcatcc 1680
tcctggaaga ccccgtcggg cttctgcttc tccaggatca gccatttaac agccccgcag 1740
aggacctggg agtcgatggc aatgaggttg acagccagag agaagacctt gaccacgtag 1800
gcggtcagcc aggtgctggg tgcccggttc aggaaggccg caaaggcaga gctgggttgt 1860
ctgaaggcca gctgctgggt gtaccccttc ttgatgagct ccaaggcccc ctgccgcttc 1920
tccgggccga acttctccca ctgttccgtt tcatccaggt aatgcacagc gatgactgtg 1980
ggcgtcatgg tgatcatgtt ctgttctccg cagcccgagg gggtcacgat gaggtgcttc 2040
agccgttccg catcgatggc atcctctgtc atctgggcca ccggggtccc ttgcaggaga 2100
attctggtct cagactcggt gtccgggact tggtcactga ggtctgcagg tgggacgtcc 2160
tctctctgca ctccttcctg gcccaggcgt tctggatcca gcgtgcgaac agccacagtt 2220
ttgttcattc tgattccttc cggcacgacc ttcagggact tcctgacacc gtcactgatg 2280
aaaaaatggt agacggcagc cttgacttcc acttcctgct ggccggtctt taggggcacg 2340
atgacataag gaacggacag cgaggacttg ggggggatgg ttacggtctg ctggtgacgc 2400
ctcttggcgg tggccaggct gcagaaggct ggattgtgga gtagttccac cctcaccttg 2460
agctcttggt tctgccggta attgtagaga acagctcgga tttccacctg ctcgtttcga 2520
acaacagagt agggtagccg caggtcgatg aagaagtcct gcattactgt gacctcgaag 2580
gggtctgcca cacagatccc tttcttgtct gacaagctca cggccagaat ctcccacgtg 2640
gtgatggagt ctttcaaaaa tatattcatg agcttcgtgg agattccgtt tttcggtgcc 2700
tctttcaact cttcaatctt ccacagccaa ctctctggga actcacttcg ggaaacgatg 2760
ttctcttctg cgatgatgtc ctcatccagg ttactcctgg ccaggcccag gtgactggcc 2820
```

-continued

```
cgcgcgtgct gccgccgcag ctcggtgatg tagttgcagc agtccaggaa ggccttcttg 2880
cacgcctcgt ccagggtgat gtaacgggtc cggcgctggc atgagaacct catggggttc 2940
tcccgcatac cgtgctcgca gcacttgcgc agctccttgg ggtactgacc aactttgtcc 3000
attctcttct ccgcgagctg cacggaacgg cgtcggcggg cggctggctg tgggcactga 3060
agttctgccc tctgggccgt ctgctggcca ctgctgctcg caaaggtcag gcctgcatcc 3120
gagaagacac cagcgtaatc cttcccactg cctggggtgc agccgatgtc tgccttctcc 3180
accacgtccc agatcttact ctgcgtcagc ttgttcttct tattcagcac aaacacgccc 3240
ttgtccacag ccaccagtcc cacccgggcc ccgtggtcac cctctatctt cagggtcatc 3300
tgctgcccgg gtaaaggctg cctgtcttct gactggccgc tttttaccac cagcgagccc 3360
acgcaagagt ccttgacgtc cacccacacg gagtcggcca ccacttccct ctggccgttg 3420
gcgccgatca gcgtgtagta ggccaccagg cggaaggaag ggatgaagtc ggtggtgatg 3480
gacaggggca gcaccaccag gtcctggcca ggctctcgca cctggcgtcc caccttcaac 3540
agcttgcctt tgttcataat caggtaggtg tagtagcgga tcttggcctc ctgggtgcgg 3600
tccattcgca ggaggaagtt gacgttgagg gtctccccag gtctgagctc tgcacgtggc 3660
actgagagat gcaggtaatt gttggagttg cccacggtgc tgtagggctg agcctccatg 3720
gtcctggtag cctgctccgc ctccgagagc tcccgcttct tcgtgcgcac cgtgatgctc 3780
aagggcttct ggctggggtg tgtgttgatg ctgagtttgg ccacgccgtc tccctgggtt 3840
agagactgca cagcgtcctc gccctggact gccacgggga ctcggtaggc tggagagcca 3900
tcggggttcg tcacgaacac catgaggtca aagggcattc ctggtttgaa gtacttgggc 3960
gtcttggtga agtggatctg gtagggagag gtcacgatgg ggatcccgct gcgctccgcc 4020
tgcaccatgt cactgcctga gtgcaggata acggtgacag acacatacaa ggacttcccc 4080
actaggtctt ccggtcgggg attctgcacc ccgtccagca gtaccttccg gctcagcacg 4140
gcgtctcctg agccatcctc aatctggatg cgcttgaggg attcaggcag ggaaatcctc 4200
tgctcgccat cctggatccc gaagatgaca aaggcagttc cctccacttt ctttccatag 4260
aggaacctgg cggtgatggt gacctccagg cccttctggt tatagatgta gtagaatttc 4320
tctgtaggct ccactatgac ctcgaaactg ggcagcacgt actccttcac ctcaaactca 4380
gtggagaaga cctgttgcgg cgaattttca tagtaggctc ggatcttcca ctggcccatg 4440
ttgacgagtt ccggaatgtc ccaagacaag ggcaagatgc caaattggtt ctgagaagac 4500
aaggagtcct gcttgaccgg gatgccgtcc gggttctcaa tgttgaccac gaccgtccgg 4560
cccacgggta gcagcttgtg gttgacggtg aagatccgac agagaactgt ggagccaggg 4620
gtgtagatgg tcttgtctgt ctggatgaag aggtacccgc tctgaaggct gaccagtacc 4680
accttctcca ccacttgggc cccgaaggtg gcctgcacag tcacgaactt gttgtgcccc 4740
ttttctgact tgaactcctt gttggctggg atcctgatgg tgacgctgcc catgtggctg 4800
gtggcagggg tcagcacggt cttctcactg gacagcacca gttttttgcc tgggaagtcg 4860
tggacagtga cagtgaccgg aacatcccca ttcgcgtcat gggcctccag caccacggtc 4920
tcctcactct ccagccgcaa gacgtttggg gtgatcatag agtacatggg agtccccaga 4980
gccaggggga ggtggattag tagcaggagc agcaggctgg gacctgaggt gagtcccatg 5040
gtgctgggac agtgcagggt cagagggaca gagggacaga gggagaggat ggggaggagt 5100
gagcagtgac tgctggagtt ggcttt                                      5126
```

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (1646 sequences)

SEQ ID NO: 1 - DNA, 5148 bp, Homo sapiens
  source 1..5148: mol_type = genomic DNA
agataaaaagccagctccagcaggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctcaaaaaaaaaaaaaaaaa

SEQ ID NO: 2 - DNA, 5139 bp, Mus musculus
  source 1..5139: mol_type = genomic DNA
agagaggagagccatataaagagccagcggctacagccccagctcgcctctgcccacccctgccccttaccccttcattccttccacctttttccttcactatgggaccagcttcagggtcccagctactagtgctactgctgctgttggccagctccccattagctctggggatccccatgtattccatcattactcccaatgtcctacggctggagagcgaagagaccatcgtactggaggcccacgatgctcagggtgacatcccagtcacagtcactgtgcaagacttcctaaagaggcaagtgctgaccagtgagaagacagtgttgacaggagccagtggacatctgagaagcgtctccatcaagattccagccagtaaggaattcaactcagataaggaggggcacaagtacgtgacagtggtggcaaacttcggggaaacggtggtggagaaagcagtgatggtaagcttccagagtgggtacctcttcatccagacagacaagaccatctacacccctggctccactgtcttatatcggatcttcactgtggacaacaacctactgcccgtgggcaagacagtcgtcatcctcattgagacccccgatggcattcctgtcaagagagacattctgtcttccaacaaccaacacggcatcttgcctttgtcttggaacattcctgaactggtcaacatggggcagtggaagatccgagccttttacgaacatgcgccgaagcagatcttctccgcagagtttgaggtgaaggaatacgtgctgcccagttttgaggtccgggtggagcccacagagacattttattacatcgatgacccaaatggcctggaagtttccatcatagccaagttcctgtacgggaaaaacgtggacgggacagccttcgtgatttttggggtccaggatggcgataagaagatttctctggcccactccctcacgcgcgtagtgattgaggatggtgtgggggatgcagtgctgacccggaaggtgctgatggagggggtacggccttccaacgccgacgccctggtggggaagtccctgtatgtctccgtcactgtcatcctgcactcaggtagtgacatggtagaggcagagcgcagtgggatcccgattgtcacttccccgtaccagatccacttcaccaagacacccaaattcttcaagccagccatgccctttgacctcatggtgttcgtgaccaaccccgatggctctccggccagcaaagtgctggtggtcactcagggatctaatgcaaaggctctcacccaagatgatggcgtggccaagctaagcatcaacacacccaacagccgccaacccctgaccatcacagtccgcaccaagaaggacactctcccagaatcacggcaggccaccaagacaatggaggcccatccctacagcactatgcacaactccaacaactacctacacttgtcagtgtcacgaatggagctcaagccgggggacaacctcaatgtcaacttccacctgcgcacagacccaggccatgaggccaagatccgatactacacctacctggttatgaacaaggggaagctcctgaaggcaggccgccaggttcgggagcctggccaggacctggtggtcttgtccctgcccatcactccagagtttattccttcatttcgcctggtggcttactacaccctgattggagctagtggccagagggaggtggtggctgactctgtgtgggtggatgtgaaggattcctgtattggcacgctggtggtgaagggtgacccaagagataaccatctcgcacctgggcaacaaacgacactcaggattgaaggaaaccagggggcccgagtggggctagtggctgtggacaagggagtgtttgtgctgaacaagaagaacaaactcacacagagcaagatctgggatgtggtagagaaggcagacattggctgcaccccaggcagtgggaagaactatgctggtgtcttcatggatgcaggcctggccttcaagacaagccaaggactgcagactgaacagagagcagatcttgagtgcaccaagccagcagcccgccgccgtcgctcagtacagttgatggaaagaaggatggacaaagctggtcagtacactgacaagggtcttcggaagtgttgtgaggatggtatgcgggatatccctatgagatacagctgccagcgccgggcacgcctcatcacccagggcgagaactgcataaaggccttcatagactgctgcaaccacatcaccaagctgcgtgaacaacacagaagagaccacgtgctgggcctggccaggagtgaattggaggaagacataattccagaagaagatattatctctagaagccacttcccacagagctggttgtggaccatagaagagttgaaagaaccagagaaaaatggaatctctacgaaggtcatgaacatctttctcaaagattccatcaccacctgggagattctggcagtgagcttgtcagacaagaaagggatctgtgtggcagacccctatgagatcagagtgatgcaggacttcttcattgacctgcggctgccctactctgtagtgcgcaacgaacaggtggagatcagagctgtgctcttcaactaccgtgaacaggaggaacttaaggtgagggtggaactgttgcataatccagccttctgcagcatggccaccgccaagaatcgctacttccagaccatcaaaatccctcccaagtcctcggtggctgtaccgtatgtcattgtccccttgaagatcggccaacaagaggtggaggtcaaggctgctgtcttcaatcacttcatcagtgatggtgtcaagaagacactgaaggtcgtgccagaaggaatgagaatcaacaaaactgtggccatccatacactggacccagagaagctcggtcaagggggagtgcagaaggtggatgtgcctgccgcagaccttagcgaccaagtgccagacacagactctgagaccagaattatcctgcaagggagcccggtggttcagatggctgaagatgctgtggacggggagcggctgaaacacctgatcgtgacccccgcaggctgtggggaacagaacatgattggcatgacaccaacagtcattgcggtacactacctggaccagaccgaacagtgggagaagttcggcatagagaagaggcaagaggccctggagctcatcaagaaagggtacacccagcagctggccttcaaacagcccagctctgcctatgctgccttcaacaaccggccccccagcacctggctgacagcctacgtggtcaaggtcttctctctagctgccaacctcatcgccatcgactctcacgtcctgtgtggggctgttaaatggttgattctggagaaacagaagccggatggtgtctttcaggaggatgggcccgtgattcaccaagaaatgattggtggcttccggaacgccaaggaggcagatgtgtcactcacagccttcgtcctcatcgcactgcaggaagccagggacatctgtgaggggcaggtcaatagccttcctgggagcatcaacaaggcaggggagtatattgaagccagttacatgaacctgcagagaccatacacagtggccattgctgggtatgccctggccctgatgaacaaactggaggaaccttacctcggcaagtttctgaacacagccaaagatcggaaccgctgggaggagcctgaccagcagctctacaacgtagaggccacatcctacgccctcctggccctgctgctgctgaaagactttgactctgtgccccctgtagtgcgctggctcaatgagcaaagatactacggaggcggctatggctccacccaggctaccttcatggtattccaagccttggcccaatatcaaacagatgtccctgaccataaggacttgaacatggatgtgtccttccacctccccagccgtagctctgcaaccacgtttcgcctgctctgggaaaatggcaacctcctgcgatcggaagagaccaagcaaaatgaggccttctctctaacagccaaaggaaaaggccgaggcacattgtcggtggtggcagtgtatcatgccaaactcaaaagcaaagtcacctgcaagaagtttgacctcagggtcagcataagaccagcccctgagacagccaagaagcccgaggaagccaagaataccatgttccttgaaatctgcaccaagtacttgggagatgtggacgccactatgtccatcctggacatctccatgatgactggctttgctccagacacaaaggacctggaactgctggcctctggagtagatagatacatctccaagtacgagatgaacaaagccttctccaacaagaacaccctcatcatctacctagaaaagatttcacacaccgaagaagactgcctgaccttcaaagttcaccagtactttaatgtgggacttatccagcccgggtcggtcaaggtctactcctattacaacctcgaggaatcatgcacccggttctatcatccagagaaggacgatgggatgctcagcaagctgtgccacagtgaaatgtgccggtgtgctgaagagaactgcttcatgcaacagtcacaggagaagatcaacctgaatgtccggctagacaaggcttgtgagcccggagtcgactatgtgtacaagaccgagctaaccaacatagagctgttggatgattttgatgagtacaccatgaccatccagcaggtcatcaagtcaggctcagatgaggtgcaggcagggcagcaacgcaagttcatcagccacatcaagtgcagaaacgccctgaagctgcagaaagggaagaagtacctcatgtggggcctctcctctgacctctggggagaaaagcccaacaccagctacatcattgggaaggacacgtgggtggagcactggcctgaggcagaagaatgccaggatcagaagtaccagaaacagtgcgaagaacttggggcattcacagaatctatggtggtttatggttgtcccaactgactacagcccagccctctaataaagcttcagttgtatttcacccatc

SEQ ID NO: 3 - DNA, 5091 bp, Rattus norvegicus
  source 1..5091: mol_type = genomic DNA
ctaccccttacccctcactccttccacctttgtcctttaccatgggacccacgtcagggtcccagctactagtgctactgctgctgttggccagctccctgctagctctggggagccccatgtactccatcattactcccaatgtcctgcggctggagagtgaagagactttcatactagaggcccatgatgctcagggtgatgtcccagtcactgtcactgtgcaagacttcctaaagaagcaagtgctgaccagtgagaagacagtgttgacaggagccactggacatctgaacagggtctccatcaagattccagccagtaaggaattcaatgcagataaggggcacaagtacgtgacagtggtggcaaacttcggggcaacagtggtggagaaagcggtgctagtaagctttcagagtggttacctcttcatccagacagacaagaccatctacaccccaggctccactgttttctatcggatcttcactgtggacaacaacctattgcctgtgggcaagacagtcgtcatcgtcattgagaccccggacggcgttcccatcaagagagacattctatcttcccacaaccaatatggcatcttgcctttgtcttggaacattccagaactggtcaacatggggcagtggaagatccgagccttctatgaacatgcaccaaagcagaccttctctgcagagtttgaggtgaaggaatacgtgctgcccagtttcgaagtcctggtggagcctacagagaaattttattacatcgatgacccaaagggcctggaagtttccatcacagccagattcctgtatgggaagaacgtggacgggacagctttcgtgatctttggggtccaggatgaggataagaagatttctctggcccagtccctcacccgcgtgctgatcgaggatggttcaggggaggcagtgctcagccgaaaagtgctgatggacggggtacggccctccagcccagaagccctagtggggaagtccctgtacgtctctgtcactgttatcctgcactcaggtagcgacatggtagaggcagagcgcagtgggatcccaattgtcacttccccgtaccagatccacttcaccaagacacccaaattcttcaagccagccatgcctttcgacctcatggtgtttgtgaccaaccctgatggctctccagcccgcagagtgccagtagtcactcagggatccgacgcgcaggctctcacccaggatgatggtgtggccaagctgagcgtcaacacacccaacaaccgccaacccctgactatcacggtccgcaccaagaaggagggtatcccggacgcgcggcaggccaccaggacgatgcaggcccagccctacagcactatgcacaattccaacaactacctgcacttgtcagtgtctcgggtggagctcaagcctggggacaacctcaatgtcaacttccacctgcgcacggacgctggccaagaggccaagatccgatactacacctatctggttatgaacaaggggaagttactgaaggcaggccgtcaggttcgggagcctggccaggacctggtggtcttgtcactgcccatcactccagaatttataccttccttccgcctggtggcttactacaccctgattggagctaatggccaaagggaggtggtggccgactcagtgtgggtggatgtgaaggactcctgtgtaggcacgctggtggtgaaaggtgacccaagagataaccgacagcccgcgcctgggcatcaaacgacactaaggatcgaggggaaccagggggcccgagtggggctagtggctgtggacaagggggtgtttgtgctgaacaagaagaacaaactcacacagagcaagatctgggatgtagtagagaaggcagacattggctgcaccccaggcagtgggaagaactatgcgggtgtcttcatggatgctggcctgaccttcaagacaaaccaaggcctgcagactgatcagagagaagatcctgagtgcgccaagccagctgcccgccgccgtcgctcagtgcagttgatggaaaggaggatggacaaagctggtcagtacaccgacaagggtctgcggaagtgttgtgaggatggcatgcgtgatatccctatgaagtacagctgccagcgccgggctcgcctcatcacccagggcgagagctgcctgaaggccttcatggactgctgcaactatatcaccaagcttcgtgagcagcacagaagagaccatgtgctgggcctggccaggagtgatgtggatgaagacataatcccagaagaagatattatctctagaagccacttcccagagagctggttgtggaccatagaagagttgaaagaaccagagaaaaatggaatctctacgaaggtcatgaacatctttctcaaagattccatcaccacctgggagattctggcagtgagcttgtccgacaagaaagggatctgtgtggcagacccctatgagatcacagtgatgcaggacttcttcattgacctgcgactgccctactctgtggtgcgcaatgaacaggtggagatcagagctgtgctcttcaattaccgtgaacaggagaaacttaaggtaagggtggaactgttgcataacccagccttctgcagcatggccactgccaagaagcggtactaccagaccatcgaaatccctcccaagtcctctgtggctgtgccttatgtcattgtccccttgaagatcggcctccaggaggtggaggtcaaggccgccgtcttcaaccacttcatcagtgatggtgtcaagaagatactgaaggtcgtgccagaaggaatgagagtcaacaaaactgtggctgtccgtacactggatccagaacacctcggtcaagggggagtgcagagggaggatgtacctgcagcagacctcagtgaccaagtgccagacacagattctgagaccagaattctcctgcaagggaccccggtggctcagatggccgaggacgctgtggacggggagcggctgaaacacctgatcgtgaccccctctggctgtggggagcagaacatgattggcatgacacccacggtcattgcagtacactatctggatcagaccgaacagtgggagaaattcggcctagagaagaggcaagaagctctggagctcatcaagaaagggtacacccagcagctggctttcaaacagcccagctctgcctatgctgccttcaacaaccggcctcccagcacctggctgacagcctatgtggtcaaggtcttctctctggctgccaacctcatcgccatcgactctcaggtcctgtgtggggctgtcaaatggctgattctggagaaacagaagccagatggtgtctttcaggaggacggaccagtgattcaccaagaaatgattggtggcttccggaacaccaaggaggcagatgtgtcgcttacagcctttgtcctcatcgcactgcaggaagccagagatatctgtgaggggcaggtcaacagccttcccgggagcatcaacaaggcaggggagtatcttgaagccagttacctgaacctgcagagaccatacacagtagccattgctgggtatgccctggccctgatgaacaaactggaggaaccttacctcaccaagtttctgaacacagccaaagatcggaaccgctgggaggagcctggccagcagctctacaatgtggaggccacctcctacgccctcctggccctgctgctgctgaaagactttgactctgtgcctcctgtggtgcgctggctcaacgagcaaagatactacggaggtggctatggctccacgcaggctaccttcatggtattccaagccttggctcaataccaaacagatgtccctgaccacaaggacttgaacatggatgtgtccctccacctccccagccgcagctccccaactgtgtttcgcctgctatgggaaagtggcagtctcctgagatcagaagagaccaagcagaatgagggcttttctctgacagccaaaggaaaaggccaaggcacactgtcggtggtgacagtgtatcacgccaaagtcaaaggcaaagccacctgcaagaagtttgacctcagggtcaccataaaaccagcccctgagacagccaagaagccccaggatgccaagagttctatgatccttgacatctgcaccaggtacttgggagacgtggatgctactatgtccatcctggacatctccatgatgactggctttattccagacacaaacgacctggaactgctgagctctggagtagacagatacatttccaagtatgagatggacaaagccttctccaacaagaacaccctcatcatctacctagaaaagatctcacactccgaagaagactgcctgtccttcaaagtccaccagttctttaacgtgggacttatccagccggggtcggtcaaggtctactcctactacaatctagaggagtcatgcacccggttctatcatccggagaaggacgatggaatgctgagcaagctgtgccacaatgaaatgtgccgctgtgcagaggagaactgcttcatgcatcagtcacaggatcaggtcagcctgaatgaacgactagacaaggcttgtgagcctggagtggactacgtgtacaagaccaagctaacgacgatagagctgtcggatgattttgatgagtacatcatgaccatcgagcaggtcatcaagtcaggctcagatgaggtgcaggcaggtcaggaacgaaggttcatcagccacgtcaagtgcagaaacgccctaaagctgcagaaagggaagcagtacctcatgtggggcctctcctccgacctctggggagaaaagcccaataccagctacatcattgggaaggacacgtgggtggagcactggcccgaggcagaggaatgtcaggatcagaagaaccagaaacagtgcgaagacctcggggcattcacagaaacaatggtggttttcggctgccccaactgaccacaacctccaataaagcttcagttgtattttacccatcaaaaaaaaaaaaaaaaaa

SEQ ID NO: 4 - DNA, 5126 bp, Macaca fascicularis
  source 1..5126: mol_type = genomic DNA
aaagccaactccagcagtcactgctcactcctccccatcctctccctctgtccctctgtccctctgaccctgcactgtcccagcaccatgggactcacctcaggtcccagcctgctgctcctgctactaatccacctccccctggctctggggactcccatgtactctatgatcaccccaaacgtcttgcggctggagagtgaggagaccgtggtgctggaggcccatgacgcgaatggggatgttccggtcactgtcactgtccacgacttcccaggcaaaaaactggtgctgtccagtgagaagaccgtgctgacccctgccaccagccacatgggcagcgtcaccatcaggatcccagccaacaaggagttcaagtcagaaaaggggcacaacaagttcgtgactgtgcaggccaccttcggggcccaagtggtggagaaggtggtactggtcagccttcagagcgggtacctcttcatccagacagacaagaccatctacacccctggctccacagttctctgtcggatcttcaccgtcaaccacaagctgctacccgtgggccggacggtcgtggtcaacattgagaacccggacggcatcccggtcaagcaggactccttgtcttctcagaaccaatttggcatcttgcccttgtcttgggacattccggaactcgtcaacatgggccagtggaagatccgagcctactatgaaaattcgccgcaacaggtcttctccactgagtttgaggtgaaggagtacgtgctgcccagtttcgaggtcatagtggagcctacagagaaattctactacatctataaccagaagggcctggaggtcaccatcaccgccaggttcctctatggaaagaaagtggagggaactgcctttgtcatcttcgggatccaggatggcgagcagaggatttccctgcctgaatccctcaagcgcatccagattgaggatggctcaggagacgccgtgctgagccggaaggtactgctggacggggtgcagaatccccgaccggaagacctagtggggaagtccttgtatgtgtctgtcaccgttatcctgcactcaggcagtgacatggtgcaggcggagcgcagcgggatccccatcgtgacctctccctaccagatccacttcaccaagacgcccaagtacttcaaaccaggaatgccctttgacctcatggtgttcgtgacgaaccccgatggctctccagcctaccgagtccccgtggcagtccagggcgaggacgctgtgcagtctctaacccagggagacggcgtggccaaactcagcatcaacacacaccccagccagaagcccttgagcatcacggtgcgcacgaagaagcgggagctctcggaggcggagcaggctaccaggaccatggaggctcagccctacagcaccgtgggcaactccaacaattacctgcatctctcagtgccacgtgcagagctcagacctggggagaccctcaacgtcaacttcctcctgcgaatggaccgcacccaggaggccaagatccgctactacacctacctgattatgaacaaaggcaagctgttgaaggtgggacgccaggtgcgagagcctggccaggacctggtggtgctgcccctgtccatcaccaccgacttcatcccttccttccgcctggtggcctactacacgctgatcggcgccaacggccagagggaagtggtggccgactccgtgtgggtggacgtcaaggactcttgcgtgggctcgctggtggtaaaaagcggccagtcagaagacaggcagcctttacccgggcagcagatgaccctgaagatagagggtgaccacggggcccgggtgggactggtggctgtggacaagggcgtgtttgtgctgaataagaagaacaagctgacgcagagtaagatctgggacgtggtggagaaggcagacatcggctgcaccccaggcagtgggaaggattacgctggtgtcttctcggatgcaggcctgacctttgcgagcagcagtggccagcagacggcccagagggcagaacttcagtgcccacagccagccgcccgccgacgccgttccgtgcagctcgcggagaagagaatggacaaagttggtcagtaccccaaggagctgcgcaagtgctgcgagcacggtatgcgggagaaccccatgaggttctcatgccagcgccggacccgttacatcaccctggacgaggcgtgcaagaaggccttcctggactgctgcaactacatcaccgagctgcggcggcagcacgcgcgggccagtcacctgggcctggccaggagtaacctggatgaggacatcatcgcagaagagaacatcgtttcccgaagtgagttcccagagagttggctgtggaagattgaagagttgaaagaggcaccgaaaaacggaatctccacgaagctcatgaatatatttttgaaagactccatcaccacgtgggagattctggccgtgagcttgtcagacaagaaagggatctgtgtggcagaccccttcgaggtcacagtaatgcaggacttcttcatcgacctgcggctaccctactctgttgttcgaaacgagcaggtggaaatccgagctgttctctacaattaccggcagaaccaagagctcaaggtgagggtggaactactccacaatccagccttctgcagcctggccaccgccaagaggcgtcaccagcagaccgtaaccatcccccccaagtcctcgctgtccgttccttatgtcatcgtgcccctaaagaccggccagcaggaagtggaagtcaaggctgccgtctaccattttttcatcagtgacggtgtcaggaagtccctgaaggtcgtgccggaaggaatcagaatgaacaaaactgtggctgttcgcacgctggatccagaacgcctgggccaggaaggagtgcagagagaggacgtcccacctgcagacctcagtgaccaagtcccggacaccgagtctgagaccagaattctcctgcaagggaccccggtggcccagatgacagaggatgccatcgatgcggaacggctgaagcacctcatcgtgaccccctcgggctgcggagaacagaacatgatcaccatgacgcccacagtcatcgctgtgcattacctggatgaaacggaacagtgggagaagttcggcccggagaagcggcagggggccttggagctcatcaagaaggggtacacccagcagctggccttcagacaacccagctctgcctttgcggccttcctgaaccgggcacccagcacctggctgaccgcctacgtggtcaaggtcttctctctggctgtcaacctcattgccatcgactcccaggtcctctgcggggctgttaaatggctgatcctggagaagcagaagcccgacggggtcttccaggaggatgcgcccgtgatacatcaagaaatgactggtggattccggaacaccaacgagaaagacatggccctcacggcctttgttctcatctcgctgcaagaggctaaagagatttgcgaggagcaggtcaacagcctgcccggcagcatcactaaagcaggagacttccttgaagccaactacatgaacctacagagatcctacactgtggccatcgctgcctatgccctggcccagatgggcaggctgaagggacctcttctcaacaaatttctgaccacagccaaagataagaaccgctgggaggagcctggtcagcagctctacaatgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggatgtccctgatcacaaggaactgaacctggatgtgtccctccaactgcccagtcgcagctccaagatcatccaccgtatccactgggaatctgccagcctcctgcgatcagaagagaccaaggaaaatgagggtttcacagtcacagctgaaggaaaaggccaaggcaccttgtcggtagtgacaatgtaccatgctaaggccaaaggtcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatactggacatatccatgatgactggcttcgttccagacacagatgacctcaagcagctggcaaacggcgttgacagatacatctccaagtatgagctggacaaagccttctccgataggaacaccctcatcatctacctggacaaggtctcacactctgaggatgactgtatagctttcaaagttcaccaatattttaatgtagagcttatccagcctggtgcagtcaaggtctacgcctattacaacctggcggaaagctgtacccggttctaccacccagaaaaggaggatggaaagctgaacaagctctgtcgtgatgagctgtgccgctgtgctgaggagaattgcttcatacaaaagttggatgacaaagtcaccctggaagaacggctggacaaggcctgtgagccaggagtggactatgtgtacaagacccgactggtcaaggcccagctgtccaatgactttgacgagtacatcatggccattgagcagatcatcaagtcaggctcggatgaggtgcaggttggacaacagcgcacgttcatcagccccatcaagtgcagggaagccctgaagctggaggagaggaaacactacctcatgtggggtctctcctccgatttctggggagagaaacccaatctcagctacatcatcgggaaggacacctgggtggagcactggcccgaggaggacgaatgccaagatgaagagaaccagaaacaatgccaggacctcggcaccttcactgagaacatggttgtctttgggtgccccaactgaccacacccccattcccccactcccaataaagcttcagttatatttca

SEQ ID NO: 5 - DNA, 5148 bp, Homo sapiens
  source 1..5148: mol_type = genomic DNA
tttttttttttttttttgagatataactgaagctttatctggagtgggggaatgggggtgtggtcagttggggcacccaaagacaaccatgctctcggtgaaggcgccgaggtcctggcattgtttctggttctcttcgtcttggcattcgtcctcctcgggccagtgctccacccaagtgtccttcccgatgatgtagctgaggttgggcttctctccccagaaatcggaggagagaccccacatgaggtagtgtttcttctcctccagcttcagggcttctctgcacttgatggggctgatgaacgtgcgctgctgtccaacctgcacctcatccgagcctgacttgatggtctgctcaatggccatgatgtactcgtcaaagtcattggacagctgaaccttgaccagtcgggtcttgtacacatagtccactcctggctcacaggccttgtccagccgttcttccagggtgaccttgtcatccgacttttgtatgaagcaattctcctcagcacagcggcacagttcatcacggcagagcttgttcagctttccatcctccttttccggatggtagaaccgggtacagctttcctccaggttgtaataggcgtagaccttgactgctccaggctggataagctctacattaaagtattggtgaactttgaaagctagacagtcatcctcagagtgtgagaccttgtccaggtagatgatgagggtgttcctatcggagaaggctttgtccagctcatacttggagatgtatctgtcaacaccattggccagctgcttcaggtcatctgtgtctggagcaaagccagtcatcatggatatgtccaatatagacatagtggcatcctggtctccccggtacctggtacagatctcaaggatcatagtgttcttggcatcctgaggcctcttttctgtttccggtgctggttttatggtgaccttgaggtcgaatttattacaggtgagttgatctttggccttagcatggtacattgtcaccaccgacaaggtgccttggccttttccttcagctgtgactgtgaaaccctcattttccttggtctcttctgatcgcaggaggctggcagattcccagtggatacggtgggtgatcttggagctgcggctgggcagttggagggacacatcaaggttcagttcctggtggtcaggggcgtccttttggtattgagccaaggcttggaacaccatgaaggtggcctgggtagagccatagccaccaccgtagtatctctgttcattgagccaacgcacgacgggaggcacaaagtcaaagtcttttagctgcagtagggccaagagggcataggatgtggcctccacgttgtagagctgcttaccagggtcctcccagcggttcttatctttggctgtggtcagaaatttgttaagaagaggccccttcagcctgcccatctgggccagagcatagccagcaatggccacagtgtaggatctctgtaggttcatgtagttggcttcaaggaagtctcctgctttagtgatgctgcctggcaggctgttgacctgctcctcgcaaatatctttagcctcctgcagcgagatgagaacaaaggccgtgagggccatgtctttctcgttgttgttccgtaatccaccaatcatttcttggtgtatcacgggcgcatcctcctggaagaccccgtcgggcttctgcttctccaggatcagccatttaacagccccgcagaggacttgggagtcgatggcgatgaggttgacagccagagagaagaccttgaccacgtaggcggtcagccaggtgctgggtgcccgtttcacgaaggccgcaaaggcagagctgggttgtctgaaggccagctgctgggtgtaccccttcttgatgagctccaaggccccctgccgcttctctaggccgaacttctcccactgctccgtttcatccaggtaatgcacagcgatgaccgtgggcgtcatgccgatcatgttctgttccccgcagcccgagggggtcacaatgaggtgcttcagccgttccgcgtcgacggcatcctctgtcatctgggccactggggtcccttgcaggagaattctggtctcagactcggtgtccgggacttggtcactgaggtctgcaggtgggatgtcctctttctgcactccttcacggcccaggcgttctggatccagggtgcgaacagccacagttttgttcattctgattccttccggcacgaccttcagggacttcctgacaccgtcactgatgaaatgatggtagacagcagccttgacttccacttcctgcaggccggtctttagcggcacgatgacatatggaacggacaacgaggacttgggggggatggttacggtctgctggtgacgcctcttggtggtggccaggctgcagaaggctggattgtggagtagttccaccctcaccttgagctcttggttctgccggtaattgtagagaacggctcggatttccacctgctcgtttcgaacaacagagtagggtagccgcaggtcgatgaagaagtcctgcattactgtgacctcgaaggggtctgccacacagatccctttcttgtccgacatgctcacagccagaatctcccacgtggtgatggagtctttcaaaaatatattcatgagcttcgtagagattccatttttcggtggctctttcaagtcctcaacgttccacagccagctctctgggaactcacttcgggaaacgatgttctcttctgcaatgatgtcctcatccaggttactcctggccaggcccaggtggctggcccgcgcgtgctgccgccgcagctctgtgatgtagttgcagcagtccaggaagaccttcttgcacgcctcgcccagggagatgaaacgggtccggcgctggcacgagaacctcatggggttctcccgcatgccgtcctcgcagcacttgcgcagctccttggggtacttgccgactttgtccattcgcttctccgtgagctgcacggaacggcgtcggcgggcggctggctgcgggcactgaagttctgccctctgggcggtctgctggccactgctgctcgtgaaggtcagccctgcgtcggagaagacaccggcgtaatccttcccactgcccggggtgcagccgatgtctgccttctccaccacgtcccagatcttactctgcgtcagtttgttcttcttattcagcacgaacacgcccttgtccacggccaccagtaccacccgggccccgtggtcaccctctatcttcagggtcatctgctgcccaggtacaggctgccggtcttctgactggccgctttttaccaccagcgagcccacgcaggagtccttgacgtccacccacacggagtcggccaccacctccctctggccgctggcaccgatcagcgtgtagtacgccaccaggcggaaggaagggatgaagtcggtggtgatggacaggggcagcaccaccaggtcctggccgggctctcgcacctggcgtcccgccttcaacagcctgcccttgttcatgatcaggtaggtgtagtagcggatcttggcctcgtgggcgcggtccattcgcaggaggaagttgacgttgagggtctccccgggtctgagctctgtacgtagcactgagagatgcaggtaattgttggagttgcccacggtgctgtagggcagagcctgcatggtcctggtagcctgctctgcctccgagagctcctgcttcttcgtgcgcaccgtgatgctcaagggcttctggctggggtgtgtgttgatgctgagtttggccacgccatctccctgggttagagactgcacagtgtcctcgccctggactgccacggggactcggtaggctggagagccatcagggttcgtcacgaacaccatgaggtcaaagggcattcctggtttgaagtacttgggtgtcttggtgaagtggatctggtagggagaggtcacgatggggatcccgctgcgctctgcctgcaccatgtcactgcctgagtgcaagatgacggtggcagacacgtacaaagacttccccaccaggtcttctgctcgggggttctgcaccccgtccagcagtaccttccggctcagcacaacctcccccgagccatcctcaatcggaatgcgcttgagggattcaggcagggaaatcctctgttcgccatcctggatcccgaagatgacaaaggcagttccctccactttcttcccgtagaggaacctggcggtgatggtgacctccaggcccttctcgttatagatgtagtagaatttctctgtaggctccactatgacctcgaaactgggcagcacgtactccttcacctcaaactcagtggagaagacctgctgtggtgagttttcatagtaggctcggatcttccactggcccatgttgacgagttccggaatgtcccaagacaagggcaagacgccaagctggttctgagaagacaaggagtcctgcttgaccgggatgccttccgggttctcaatgttgaccatgaccgtccggcccacgggtagcagcttgtggttgacggtgaagatccgatagagaactgtggagccaggggtgtagatggtcttgtctgtctggatgaagaggtacccgctctgcaggctgaccagcaccaccttctccaccacttgggtcccgaaggtggcctgcacggtcacgaacttgttgcgccccttttctgacttgaactccctgttggctgggatcgtgaaggtgacgttgcccatgtggttggtggcaggggtcagcacagtcttctcactggacagcactagttttttgcctgggaagtcgtggacagtaacagtgactggaacatccccttgcgcgtcgtgggcctccagcaccatggtctcctcgctctccagccgcaagatgttgggggtgatgatagagtacatgggactccccagagccagggggaggtgggttagtagcaggagcagcaggctgggacctgaggtgggtcccatggtgctgggacagtgcagggtcagagggacagagggacagagggagaggatggggaggagtgagcagcgcctgctggagctggctttttatct

SEQ ID NO: 6 - DNA, 5139 bp, Mus musculus
  source 1..5139: mol_type = genomic DNA
gatgggtgaaatacaactgaagctttattagagggctgggctgtagtcagttgggacaaccataaaccaccatagattctgtgaatgccccaagttcttcgcactgtttctggtacttctgatcctggcattcttctgcctcaggccagtgctccacccacgtgtccttcccaatgatgtagctggtgttgggcttttctccccagaggtcagaggagaggccccacatgaggtacttcttccctttctgcagcttcagggcgtttctgcacttgatgtggctgatgaacttgcgttgctgccctgcctgcacctcatctgagcctgacttgatgacctgctggatggtcatggtgtactcatcaaaatcatccaacagctctatgttggttagctcggtcttgtacacatagtcgactccgggctcacaagccttgtctagccggacattcaggttgatcttctcctgtgactgttgcatgaagcagttctcttcagcacaccggcacatttcactgtggcacagcttgctgagcatcccatcgtccttctctggatgatagaaccgggtgcatgattcctcgaggttgtaataggagtagaccttgaccgacccgggctggataagtcccacattaaagtactggtgaactttgaaggtcaggcagtcttcttcggtgtgtgaaatcttttctaggtagatgatgagggtgttcttgttggagaaggctttgttcatctcgtacttggagatgtatctatctactccagaggccagcagttccaggtcctttgtgtctggagcaaagccagtcatcatggagatgtccaggatggacatagtggcgtccacatctcccaagtacttggtgcagatttcaaggaacatggtattcttggcttcctcgggcttcttggctgtctcaggggctggtcttatgctgaccctgaggtcaaacttcttgcaggtgactttgcttttgagtttggcatgatacactgccaccaccgacaatgtgcctcggccttttcctttggctgttagagagaaggcctcattttgcttggtctcttccgatcgcaggaggttgccattttcccagagcaggcgaaacgtggttgcagagctacggctggggaggtggaaggacacatccatgttcaagtccttatggtcagggacatctgtttgatattgggccaaggcttggaataccatgaaggtagcctgggtggagccatagccgcctccgtagtatctttgctcattgagccagcgcactacagggggcacagagtcaaagtctttcagcagcagcagggccaggagggcgtaggatgtggcctctacgttgtagagctgctggtcaggctcctcccagcggttccgatctttggctgtgttcagaaacttgccgaggtaaggttcctccagtttgttcatcagggccagggcatacccagcaatggccactgtgtatggtctctgcaggttcatgtaactggcttcaatatactcccctgccttgttgatgctcccaggaaggctattgacctgcccctcacagatgtccctggcttcctgcagtgcgatgaggacgaaggctgtgagtgacacatctgcctccttggcgttccggaagccaccaatcatttcttggtgaatcacgggcccatcctcctgaaagacaccatccggcttctgtttctccagaatcaaccatttaacagccccacacaggacgtgagagtcgatggcgatgaggttggcagctagagagaagaccttgaccacgtaggctgtcagccaggtgctggggggccggttgttgaaggcagcataggcagagctgggctgtttgaaggccagctgctgggtgtaccctttcttgatgagctccagggcctcttgcctcttctctatgccgaacttctcccactgttcggtctggtccaggtagtgtaccgcaatgactgttggtgtcatgccaatcatgttctgttccccacagcctgcgggggtcacgatcaggtgtttcagccgctccccgtccacagcatcttcagccatctgaaccaccgggctcccttgcaggataattctggtctcagagtctgtgtctggcacttggtcgctaaggtctgcggcaggcacatccaccttctgcactcccccttgaccgagcttctctgggtccagtgtatggatggccacagttttgttgattctcattccttctggcacgaccttcagtgtcttcttgacaccatcactgatgaagtgattgaagacagcagccttgacctccacctcttgttggccgatcttcaaggggacaatgacatacggtacagccaccgaggacttgggagggattttgatggtctggaagtagcgattcttggcggtggccatgctgcagaaggctggattatgcaacagttccaccctcaccttaagttcctcctgttcacggtagttgaagagcacagctctgatctccacctgttcgttgcgcactacagagtagggcagccgcaggtcaatgaagaagtcctgcatcactctgatctcataggggtctgccacacagatccctttcttgtctgacaagctcactgccagaatctcccaggtggtgatggaatctttgagaaagatgttcatgaccttcgtagagattccatttttctctggttctttcaactcttctatggtccacaaccagctctgtgggaagtggcttctagagataatatcttcttctggaattatgtcttcctccaattcactcctggccaggcccagcacgtggtctcttctgtgttgttcacgcagcttggtgatgtggttgcagcagtctatgaaggcctttatgcagttctcgccctgggtgatgaggcgtgcccggcgctggcagctgtatctcatagggatatcccgcataccatcctcacaacacttccgaagacccttgtcagtgtactgaccagctttgtccatccttctttccatcaactgtactgagcgacggcggcgggctgctggcttggtgcactcaagatctgctctctgttcagtctgcagtccttggcttgtcttgaaggccaggcctgcatccatgaagacaccagcatagttcttcccactgcctggggtgcagccaatgtctgccttctctaccacatcccagatcttgctctgtgtgagtttgttcttcttgttcagcacaaacactcccttgtccacagccactagccccactcgggccccctggtttccttcaatcctgagtgtcgtttgttgcccaggtgcgagatggttatctcttgggtcacccttcaccaccagcgtgccaatacaggaatccttcacatccacccacacagagtcagccaccacctccctctggccactagctccaatcagggtgtagtaagccaccaggcgaaatgaaggaataaactctggagtgatgggcagggacaagaccaccaggtcctggccaggctcccgaacctggcggcctgccttcaggagcttccccttgttcataaccaggtaggtgtagtatcggatcttggcctcatggcctgggtctgtgcgcaggtggaagttgacattgaggttgtcccccggcttgagctccattcgtgacactgacaagtgtaggtagttgttggagttgtgcatagtgctgtagggatgggcctccattgtcttggtggcctgccgtgattctgggagagtgtccttcttggtgcggactgtgatggtcaggggttggcggctgttgggtgtgttgatgcttagcttggccacgccatcatcttgggtgagagcctttgcattagatccctgagtgaccaccagcactttgctggccggagagccatcggggttggtcacgaacaccatgaggtcaaagggcatggctggcttgaagaatttgggtgtcttggtgaagtggatctggtacggggaagtgacaatcgggatcccactgcgctctgcctctaccatgtcactacctgagtgcaggatgacagtgacggagacatacagggacttccccaccagggcgtcggcgttggaaggccgtaccccctccatcagcaccttccgggtcagcactgcatcccccacaccatcctcaatcactacgcgcgtgagggagtgggccagagaaatcttcttatcgccatcctggaccccaaaaatcacgaaggctgtcccgtccacgtttttcccgtacaggaacttggctatgatggaaacttccaggccatttgggtcatcgatgtaataaaatgtctctgtgggctccacccggacctcaaaactgggcagcacgtattccttcacctcaaactctgcggagaagatctgcttcggcgcatgttcgtaaaaggctcggatcttccactgccccatgttgaccagttcaggaatgttccaagacaaaggcaagatgccgtgttggttgttggaagacagaatgtctctcttgacaggaatgccatcgggggtctcaatgaggatgacgactgtcttgcccacgggcagtaggttgttgtccacagtgaagatccgatataagacagtggagccaggggtgtagatggtcttgtctgtctggatgaagaggtacccactctggaagcttaccatcactgctttctccaccaccgtttccccgaagtttgccaccactgtcacgtacttgtgcccctccttatctgagttgaattccttactggctggaatcttgatggagacgcttctcagatgtccactggctcctgtcaacactgtcttctcactggtcagcacttgcctctttaggaagtcttgcacagtgactgtgactgggatgtcaccctgagcatcgtgggcctccagtacgatggtctcttcgctctccagccgtaggacattgggagtaatgatggaatacatggggatccccagagctaatggggagctggccaacagcagcagtagcactagtagctgggaccctgaagctggtcccatagtgaaggaaaaaggtggaaggaatgaaggggtaaggggcaggggtgggcagaggcgagctggggctgtagccgctggctctttatatggctctcctctct

SEQ ID NO: 7 - DNA, 5091 bp, Rattus norvegicus
  source 1..5091: mol_type = genomic DNA
ttttttttttttttttttgatgggtaaaatacaactgaagctttattggaggttgtggtcagttggggcagccgaaaaccaccattgtttctgtgaatgccccgaggtcttcgcactgtttctggttcttctgatcctgacattcctctgcctcgggccagtgctccacccacgtgtccttcccaatgatgtagctggtattgggcttttctccccagaggtcggaggagaggccccacatgaggtactgcttccctttctgcagctttagggcgtttctgcacttgacgtggctgatgaaccttcgttcctgacctgcctgcacctcatctgagcctgacttgatgacctgctcgatggtcatgatgtactcatcaaaatcatccgacagctctatcgtcgttagcttggtcttgtacacgtagtccactccaggctcacaagccttgtctagtcgttcattcaggctgacctgatcctgtgactgatgcatgaagcagttctcctctgcacagcggcacatttcattgtggcacagcttgctcagcattccatcgtccttctccggatgatagaaccgggtgcatgactcctctagattgtagtaggagtagaccttgaccgaccccggctggataagtcccacgttaaagaactggtggactttgaaggacaggcagtcttcttcggagtgtgagatcttttctaggtagatgatgagggtgttcttgttggagaaggctttgtccatctcatacttggaaatgtatctgtctactccagagctcagcagttccaggtcgtttgtgtctggaataaagccagtcatcatggagatgtccaggatggacatagtagcatccacgtctcccaagtacctggtgcagatgtcaaggatcatagaactcttggcatcctggggcttcttggctgtctcaggggctggttttatggtgaccctgaggtcaaacttcttgcaggtggctttgcctttgactttggcgtgatacactgtcaccaccgacagtgtgccttggccttttcctttggctgtcagagaaaagccctcattctgcttggtctcttctgatctcaggagactgccactttcccatagcaggcgaaacacagttggggagctgcggctggggaggtggagggacacatccatgttcaagtccttgtggtcagggacatctgtttggtattgagccaaggcttggaataccatgaaggtagcctgcgtggagccatagccacctccgtagtatctttgctcgttgagccagcgcaccacaggaggcacagagtcaaagtctttcagcagcagcagggccaggagggcgtaggaggtggcctccacattgtagagctgctggccaggctcctcccagcggttccgatctttggctgtgttcagaaacttggtgaggtaaggttcctccagtttgttcatcagggccagggcatacccagcaatggctactgtgtatggtctctgcaggttcaggtaactggcttcaagatactcccctgccttgttgatgctcccgggaaggctgttgacctgcccctcacagatatctctggcttcctgcagtgcgatgaggacaaaggctgtaagcgacacatctgcctccttggtgttccggaagccaccaatcatttcttggtgaatcactggtccgtcctcctgaaagacaccatctggcttctgtttctccagaatcagccatttgacagccccacacaggacctgagagtcgatggcgatgaggttggcagccagagagaagaccttgaccacataggctgtcagccaggtgctgggaggccggttgttgaaggcagcataggcagagctgggctgtttgaaagccagctgctgggtgtaccctttcttgatgagctccagagcttcttgcctcttctctaggccgaatttctcccactgttcggtctgatccagatagtgtactgcaatgaccgtgggtgtcatgccaatcatgttctgctccccacagccagagggggtcacgatcaggtgtttcagccgctccccgtccacagcgtcctcggccatctgagccaccggggtcccttgcaggagaattctggtctcagaatctgtgtctggcacttggtcactgaggtctgctgcaggtacatcctccctctgcactcccccttgaccgaggtgttctggatccagtgtacggacagccacagttttgttgactctcattccttctggcacgaccttcagtatcttcttgacaccatcactgatgaagtggttgaagacggcggccttgacctccacctcctggaggccgatcttcaaggggacaatgacataaggcacagccacagaggacttgggagggatttcgatggtctggtagtaccgcttcttggcagtggccatgctgcagaaggctgggttatgcaacagttccacccttaccttaagtttctcctgttcacggtaattgaagagcacagctctgatctccacctgttcattgcgcaccacagagtagggcagtcgcaggtcaatgaagaagtcctgcatcactgtgatctcataggggtctgccacacagatccctttcttgtcggacaagctcactgccagaatctcccaggtggtgatggaatctttgagaaagatgttcatgaccttcgtagagattccatttttctctggttctttcaactcttctatggtccacaaccagctctctgggaagtggcttctagagataatatcttcttctgggattatgtcttcatccacatcactcctggccaggcccagcacatggtctcttctgtgctgctcacgaagcttggtgatatagttgcagcagtccatgaaggccttcaggcagctctcgccctgggtgatgaggcgagcccggcgctggcagctgtacttcatagggatatcacgcatgccatcctcacaacacttccgcagacccttgtcggtgtactgaccagctttgtccatcctcctttccatcaactgcactgagcgacggcggcgggcagctggcttggcgcactcaggatcttctctctgatcagtctgcaggccttggtttgtcttgaaggtcaggccagcatccatgaagacacccgcatagttcttcccactgcctggggtgcagccaatgtctgccttctctactacatcccagatcttgctctgtgtgagtttgttcttcttgttcagcacaaacacccccttgtccacagccactagccccactcgggccccctggttcccctcgatccttagtgtcgtttgatgcccaggcgcgggctgtcggttatctcttgggtcacctttcaccaccagcgtgcctacacaggagtccttcacatccacccacactgagtcggccaccacctccctttggccattagctccaatcagggtgtagtaagccaccaggcggaaggaaggtataaattctggagtgatgggcagtgacaagaccaccaggtcctggccaggctcccgaacctgacggcctgccttcagtaacttccccttgttcataaccagataggtgtagtatcggatcttggcctcttggccagcgtccgtgcgcaggtggaagttgacattgaggttgtccccaggcttgagctccacccgagacactgacaagtgcaggtagttgttggaattgtgcatagtgctgtagggctgggcctgcatcgtcctggtggcctgccgcgcgtccgggataccctccttcttggtgcggaccgtgatagtcaggggttggcggttgttgggtgtgttgacgctcagcttggccacaccatcatcctgggtgagagcctgcgcgtcggatccctgagtgactactggcactctgcgggctggagagccatcagggttggtcacaaacaccatgaggtcgaaaggcatggctggcttgaagaatttgggtgtcttggtgaagtggatctggtacggggaagtgacaattgggatcccactgcgctctgcctctaccatgtcgctacctgagtgcaggataacagtgacagagacgtacagggacttccccactagggcttctgggctggagggccgtaccccgtccatcagcacttttcggctgagcactgcctcccctgaaccatcctcgatcagcacgcgggtgagggactgggccagagaaatcttcttatcctcatcctggaccccaaagatcacgaaagctgtcccgtccacgttcttcccatacaggaatctggctgtgatggaaacttccaggccctttgggtcatcgatgtaataaaatttctctgtaggctccaccaggacttcgaaactgggcagcacgtattccttcacctcaaactctgcagagaaggtctgctttggtgcatgttcatagaaggctcggatcttccactgccccatgttgaccagttctggaatgttccaagacaaaggcaagatgccatattggttgtgggaagatagaatgtctctcttgatgggaacgccgtccggggtctcaatgacgatgacgactgtcttgcccacaggcaataggttgttgtccacagtgaagatccgatagaaaacagtggagcctggggtgtagatggtcttgtctgtctggatgaagaggtaaccactctgaaagcttactagcaccgctttctccaccactgttgccccgaagtttgccaccactgtcacgtacttgtgccccttatctgcattgaattccttactggctggaatcttgatggagaccctgttcagatgtccagtggctcctgtcaacactgtcttctcactggtcagcacttgcttctttaggaagtcttgcacagtgacagtgactgggacatcaccctgagcatcatgggcctctagtatgaaagtctcttcactctccagccgcaggacattgggagtaatgatggagtacatggggctccccagagctagcagggagctggccaacagcagcagtagcactagtagctgggaccctgacgtgggtcccatggtaaaggacaaaggtggaaggagtgaggggtaaggggtag

SEQ ID NO: 8 - DNA, 5126 bp, Macaca fascicularis
  source 1..5126: mol_type = genomic DNA
tgaaatataactgaagctttattgggagtgggggaatgggggtgtggtcagttggggcacccaaagacaaccatgttctcagtgaaggtgccgaggtcctggcattgtttctggttctcttcatcttggcattcgtcctcctcgggccagtgctccacccaggtgtccttcccgatgatgtagctgagattgggtttctctccccagaaatcggaggagagaccccacatgaggtagtgtttcctctcctccagcttcagggcttccctgcacttgatggggctgatgaacgtgcgctgttgtccaacctgcacctcatccgagcctgacttgatgatctgctcaatggccatgatgtactcgtcaaagtcattggacagctgggccttgaccagtcgggtcttgtacacatagtccactcctggctcacaggccttgtccagccgttcttccagggtgactttgtcatccaacttttgtatgaagcaattctcctcagcacagcggcacagctcatcacgacagagcttgttcagctttccatcctccttttctgggtggtagaaccgggtacagctttccgccaggttgtaataggcgtagaccttgactgcaccaggctggataagctctacattaaaatattggtgaactttgaaagctatacagtcatcctcagagtgtgagaccttgtccaggtagatgatgagggtgttcctatcggagaaggctttgtccagctcatacttggagatgtatctgtcaacgccgtttgccagctgcttgaggtcatctgtgtctggaacgaagccagtcatcatggatatgtccagtatagacatagtggcatcctggtctccccggtacctggtacagatctcaaggatcatagtgttcttggcatcctgaggcctcttttctgtttccggtgctggttttatggtgaccttgaggtcgaatttattacaggtgagttgacctttggccttagcatggtacattgtcactaccgacaaggtgccttggccttttccttcagctgtgactgtgaaaccctcattttccttggtctcttctgatcgcaggaggctggcagattcccagtggatacggtggatgatcttggagctgcgactgggcagttggagggacacatccaggttcagttccttgtgatcagggacatccttttggtattgagccaaggcttggaacaccatgaaggtggcctgggtagagccatagccaccaccgtagtatctctgttcattgagccaacgcacgacgggaggcacaaagtcaaagtcttttagctgcagtagggccaagagggcataggatgtggcctccacattgtagagctgctgaccaggctcctcccagcggttcttatctttggctgtggtcagaaatttgttgagaagaggtcccttcagcctgcccatctgggccagggcataggcagcgatggccacagtgtaggatctctgtaggttcatgtagttggcttcaaggaagtctcctgctttagtgatgctgccgggcaggctgttgacctgctcctcgcaaatctctttagcctcttgcagcgagatgagaacaaaggccgtgagggccatgtctttctcgttggtgttccggaatccaccagtcatttcttgatgtatcacgggcgcatcctcctggaagaccccgtcgggcttctgcttctccaggatcagccatttaacagccccgcagaggacctgggagtcgatggcaatgaggttgacagccagagagaagaccttgaccacgtaggcggtcagccaggtgctgggtgcccggttcaggaaggccgcaaaggcagagctgggttgtctgaaggccagctgctgggtgtaccccttcttgatgagctccaaggccccctgccgcttctccgggccgaacttctcccactgttccgtttcatccaggtaatgcacagcgatgactgtgggcgtcatggtgatcatgttctgttctccgcagcccgagggggtcacgatgaggtgcttcagccgttccgcatcgatggcatcctctgtcatctgggccaccggggtcccttgcaggagaattctggtctcagactcggtgtccgggacttggtcactgaggtctgcaggtgggacgtcctctctctgcactccttcctggcccaggcgttctggatccagcgtgcgaacagccacagttttgttcattctgattccttccggcacgaccttcagggacttcctgacaccgtcactgatgaaaaaatggtagacggcagccttgacttccacttcctgctggccggtctttaggggcacgatgacataaggaacggacagcgaggacttgggggggatggttacggtctgctggtgacgcctcttggcggtggccaggctgcagaaggctggattgtggagtagttccaccctcaccttgagctcttggttctgccggtaattgtagagaacagctcggatttccacctgctcgtttcgaacaacagagtagggtagccgcaggtcgatgaagaagtcctgcattactgtgacctcgaaggggtctgccacacagatccctttcttgtctgacaagctcacggccagaatctcccacgtggtgatggagtctttcaaaaatatattcatgagcttcgtggagattccgtttttcggtgcctctttcaactcttcaatcttccacagccaactctctgggaactcacttcgggaaacgatgttctcttctgcgatgatgtcctcatccaggttactcctggccaggcccaggtgactggcccgcgcgtgctgccgccgcagctcggtgatgtagttgcagcagtccaggaaggccttcttgcacgcctcgtccagggtgatgtaacgggtccggcgctggcatgagaacctcatggggttctcccgcataccgtgctcgcagcacttgcgcagctccttggggtactgaccaactttgtccattctcttctccgcgagctgcacggaacggcgtcggcgggcggctggctgtgggcactgaagttctgccctctgggccgtctgctggccactgctgctcgcaaaggtcaggcctgcatccgagaagacaccagcgtaatccttcccactgcctggggtgcagccgatgtctgccttctccaccacgtcccagatcttactctgcgtcagcttgttcttcttattcagcacaaacacgcccttgtccacagccaccagtcccacccgggccccgtggtcaccctctatcttcagggtcatctgctgcccgggtaaaggctgcctgtcttctgactggccgctttttaccaccagcgagcccacgcaagagtccttgacgtccacccacacggagtcggccaccacttccctctggccgttggcgccgatcagcgtgtagtaggccaccaggcggaaggaagggatgaagtcggtggtgatggacaggggcagcaccaccaggtcctggccaggctctcgcacctggcgtcccaccttcaacagcttgcctttgttcataatcaggtaggtgtagtagcggatcttggcctcctgggtgcggtccattcgcaggaggaagttgacgttgagggtctccccaggtctgagctctgcacgtggcactgagagatgcaggtaattgttggagttgcccacggtgctgtagggctgagcctccatggtcctggtagcctgctccgcctccgagagctcccgcttcttcgtgcgcaccgtgatgctcaagggcttctggctggggtgtgtgttgatgctgagtttggccacgccgtctccctgggttagagactgcacagcgtcctcgccctggactgccacggggactcggtaggctggagagccatcggggttcgtcacgaacaccatgaggtcaaagggcattcctggtttgaagtacttgggcgtcttggtgaagtggatctggtagggagaggtcacgatggggatcccgctgcgctccgcctgcaccatgtcactgcctgagtgcaggataacggtgacagacacatacaaggacttccccactaggtcttccggtcggggattctgcaccccgtccagcagtaccttccggctcagcacggcgtctcctgagccatcctcaatctggatgcgcttgagggattcaggcagggaaatcctctgctcgccatcctggatcccgaagatgacaaaggcagttccctccactttctttccatagaggaacctggcggtgatggtgacctccaggcccttctggttatagatgtagtagaatttctctgtaggctccactatgacctcgaaactgggcagcacgtactccttcacctcaaactcagtggagaagacctgttgcggcgaattttcatagtaggctcggatcttccactggcccatgttgacgagttccggaatgtcccaagacaagggcaagatgccaaattggttctgagaagacaaggagtcctgcttgaccgggatgccgtccgggttctcaatgttgaccacgaccgtccggcccacgggtagcagcttgtggttgacggtgaagatccgacagagaactgtggagccaggggtgtagatggtcttgtctgtctggatgaagaggtacccgctctgaaggctgaccagtaccaccttctccaccacttgggccccgaaggtggcctgcacagtcacgaacttgttgtgccccttttctgacttgaactccttgttggctgggatcctgatggtgacgctgcccatgtggctggtggcaggggtcagcacggtcttctcactggacagcaccagttttttgcctgggaagtcgtggacagtgacagtgaccggaacatccccattcgcgtcatgggcctccagcaccacggtctcctcactctccagccgcaagacgtttggggtgatcatagagtacatgggagtccccagagccagggggaggtggattagtagcaggagcagcaggctgggacctgaggtgagtcccatggtgctgggacagtgcagggtcagagggacagagggacagagggagaggatggggaggagtgagcagtgactgctggagttggcttt

SEQ ID NO: 9-13 - skipped (5 entries)

SEQ ID NO: 14 - protein, 8 aa, synthetic construct
  REGION 1..8: note = source = /note="Description of Artificial Sequence: Synthetic peptide"
GRGDSPKC

SEQ ID NO: 15 - protein, 16 aa, unidentified
  REGION 1..16: note = source = /note="Description of Unknown: RFGF peptide"
AAVALLPAVLLALLAP

SEQ ID NO: 16 - protein, 11 aa, unidentified
  REGION 1..11: note = source = /note="Description of Unknown: RFGF analogue peptide"
AALLPVLLAAP

SEQ ID NO: 17 - protein, 13 aa, Human immunodeficiency virus
GRKKRRQRRRPPQ

SEQ ID NO: 18 - protein, 16 aa, Drosophila sp.
RQIKIWFQNRRMKWKK

SEQ ID NO: 19 - RNA, 21 nt, synthetic construct
  source 1..21: mol_type = other RNA
cgggtacctcttcatccagat

SEQ ID NO: 20 - RNA, 21 nt, synthetic construct
  source 1..21: mol_type = other RNA
gtacctcttcatccagacagt

SEQ ID NO: 21 - RNA, 21 nt, synthetic construct
  source 1..21: mol_type = other RNA
tacctcttcatccagacagat

SEQ ID NO: 22 - RNA, 21 nt, synthetic construct
  source 1..21: mol_type = other RNA
catccagacagacaagaccat

SEQ ID NO: 23 - RNA, 21 nt, synthetic construct
  source 1..21: mol_type = other RNA
ccagacagacaagaccatctt

SEQ ID NO: 24 - RNA, 21 nt, synthetic construct
  source 1..21: mol_type = other RNA
agacagacaagaccatctact

SEQ ID NO: 25 - RNA, 21 nt, synthetic construct
  source 1..21: mol_type = other RNA
gacagacaagaccatctacat

SEQ ID NO: 26 - RNA, 21 nt, synthetic construct
  source 1..21: mol_type = other RNA
attccggaactcgtcaacatt

SEQ ID NO: 27 - RNA, 21 nt, synthetic construct
  source 1..21: mol_type = other RNA
cactgagtttgaggtgaaggt

SEQ ID NO: 28 - RNA, 21 nt, synthetic construct
  source 1..21: mol_type = other RNA
actgagtttgaggtgaaggat

SEQ ID NO: 29 - RNA, 21 nt, synthetic construct
  source 1..21: mol_type = other RNA
gcccagtttcgaggtcatagt

SEQ ID NO: 30 - RNA, 21 nt, synthetic construct
  source 1..21: mol_type = other RNA
aattctactacatctataact

SEQ ID NO: 31 - RNA, 21 nt, synthetic construct
  source 1..21: mol_type = other RNA
tccctaccagatccacttcat

SEQ ID NO: 32 - RNA, 21 nt, synthetic construct
  source 1..21: mol_type = other RNA
ccctaccagatccacttcact

SEQ ID NO: 33 - RNA, 21 nt, synthetic construct
  source 1..21: mol_type = other RNA
ctaccagatccacttcaccat

SEQ ID NO: 34 - RNA, 21 nt, synthetic construct
  source 1..21: mol_type = other RNA
taccagatccacttcaccaat

SEQ ID NO: 35 - RNA, 21 nt, synthetic construct
  source 1..21: mol_type = other RNA
ccagatccacttcaccaagat

SEQ ID NO: 36 - RNA, 21 nt, synthetic construct
  source 1..21: mol_type = other RNA
gggcaactccaacaattacct

SEQ ID NO: 37 - RNA, 21 nt, synthetic construct
  source 1..21: mol_type = other RNA
gcaactccaacaattacctgt

SEQ ID NO: 38 - RNA, 21 nt, synthetic construct
  source 1..21: mol_type = other RNA
caactccaacaattacctgct

SEQ ID NO: 39 - RNA, 21 nt, synthetic construct
  source 1..21: mol_type = other RNA
caacaattacctgcatctctt

SEQ ID NO: 40 - RNA, 21 nt, synthetic construct
  source 1..21: mol_type = other RNA
caagatccgctactacacctt

SEQ ID NO: 41 - RNA, 21 nt, synthetic construct
  source 1..21: mol_type = other RNA
cgtgctgaataagaagaacat

SEQ ID NO: 42 - RNA, 21 nt, synthetic construct
  source 1..21: mol_type = other RNA
gtgctgaataagaagaacaat

SEQ ID NO: 43 - RNA, 21 nt, synthetic construct
  source 1..21: mol_type = other RNA
actgacgcagagtaagatctt

SEQ ID NO: 44 - RNA, 21 nt, synthetic construct
  source 1..21: mol_type = other RNA
tgcagaagagaacatcgtttt

SEQ ID NO: 45 - RNA, 21 nt, synthetic construct
  source 1..21: mol_type = other RNA
catgtcggacaagaaagggat

SEQ ID NO: 46 - RNA, 21 nt, synthetic construct
  source 1..21: mol_type = other RNA
atgtcggacaagaaagggatt

SEQ ID NO: 47 - RNA, 21 nt, synthetic construct
  source 1..21: mol_type = other RNA
gtcggacaagaaagggatctt

SEQ ID NO: 48 - RNA, 21 nt, synthetic construct
  source 1..21: mol_type = other RNA
cggacaagaaagggatctgtt

SEQ ID NO: 49 - RNA, 21 nt, synthetic construct
  source 1..21: mol_type = other RNA
acagtaatgcaggacttcttt

SEQ ID NO: 50 - RNA, 21 nt, synthetic construct
  source 1..21: mol_type = other RNA
agtaatgcaggacttcttcat

SEQ ID NO: 51 - RNA, 21 nt, synthetic construct
  source 1..21: mol_type = other RNA
gtaatgcaggacttcttcatt

SEQ ID NO: 52 - RNA, 21 nt, synthetic construct
  source 1..21: mol_type = other RNA
ctaccctactctgttgttcgt

SEQ ID NO: 53 - RNA, 21 nt, synthetic construct
  source 1..21: mol_type = other RNA
taccctactctgttgttcgat

SEQ ID NO: 54 - RNA, 21 nt, synthetic construct
  source 1..21: mol_type = other RNA
accctactctgttgttcgaat

SEQ ID NO: 55 - RNA, 21 nt, synthetic construct
  source 1..21: mol_type = other RNA
ccctactctgttgttcgaaat

SEQ ID NO: 56 - RNA, 21 nt, synthetic construct
  source 1..21: mol_type = other RNA
cctactctgttgttcgaaact

SEQ ID NO: 57 - RNA, 21 nt, synthetic construct
  source 1..21: mol_type = other RNA
ctactctgttgttcgaaacgt

SEQ ID NO: 58 - RNA, 21 nt, synthetic construct
  source 1..21: mol_type = other RNA
tactctgttgttcgaaacgat

SEQ ID NO: 59 - RNA, 21 nt, synthetic construct
  source 1..21: mol_type = other RNA
actctgttgttcgaaacgagt

SEQ ID NO: 60 - RNA, 21 nt, synthetic construct
  source 1..21: mol_type = other RNA
ccgttctctacaattaccggt

SEQ ID NO: 61 - RNA, 21 nt, synthetic construct
  source 1..21: mol_type = other RNA
ggtggaactactccacaatct

SEQ ID NO: 62 - RNA, 21 nt, synthetic construct
  source 1..21: mol_type = other RNA
ccgagtctgagaccagaattt

SEQ ID NO: 63 - RNA, 21 nt, synthetic construct
  source 1..21: mol_type = other RNA
gtgcattacctggatgaaact

SEQ ID NO: 64 - RNA, 21 nt, synthetic construct
  source 1..21: mol_type = other RNA
ctacgtggtcaaggtcttctt

SEQ ID NO: 65 - RNA, 21 nt, synthetic construct
  source 1..21: mol_type = other RNA
cgtggtcaaggtcttctctct

SEQ ID NO: 66 - RNA, 21 nt, synthetic construct
  source 1..21: mol_type = other RNA
gtggtcaaggtcttctctctt

SEQ ID NO: 67 - RNA, 21 nt, synthetic construct
  source 1..21: mol_type = other RNA
cgtgatacaccaagaaatgat

SEQ ID NO: 68 - RNA, 21 nt, synthetic construct
  source 1..21: mol_type = other RNA
cggcctttgttctcatctcgt

SEQ ID NO: 69 - RNA, 21 nt, synthetic construct
  source 1..21: mol_type = other RNA
gacttccttgaagccaactat

SEQ ID NO: 70 - RNA, 21 nt, synthetic construct
  source 1..21: mol_type = other RNA
ttccttgaagccaactacatt

SEQ ID NO: 71 - RNA, 21 nt, synthetic construct
  source 1..21: mol_type = other RNA
aagccaactacatgaacctat

SEQ ID NO: 72 - RNA, 21 nt, synthetic construct
  source 1..21: mol_type = other RNA
agccaactacatgaacctact

SEQ ID NO: 73 - RNA, 21 nt, synthetic construct
  source 1..21: mol_type = other RNA
caactacatgaacctacagat

SEQ ID NO: 74 - RNA, 21 nt, synthetic construct
  source 1..21: mol_type = other RNA
ttctgaccacagccaaagatt

SEQ ID NO: 75 - RNA, 21 nt, synthetic construct
  source 1..21: mol_type = other RNA
tgcagctaaaagactttgact

SEQ ID NO: 76 - RNA, 21 nt, synthetic construct
  source 1..21: mol_type = other RNA
cgtgcgttggctcaatgaact

SEQ ID NO: 77 - RNA, 21 nt, synthetic construct
  source 1..21: mol_type = other RNA
ttcatggtgttccaagccttt

SEQ ID NO: 78 - RNA, 21 nt, synthetic construct
  source 1..21: mol_type = other RNA
ctgcgatcagaagagaccaat

SEQ ID NO: 79 - RNA, 21 nt, synthetic construct
  source 1..21: mol_type = other RNA
tgcgatcagaagagaccaagt

SEQ ID NO: 80 - RNA, 21 nt, synthetic construct
  source 1..21: mol_type = other RNA
accaaggaaaatgagggtttt

SEQ ID NO: 81 - RNA, 21 nt, synthetic construct
  source 1..21: mol_type = other RNA
aaggaaaatgagggtttcact

SEQ ID NO: 82 - RNA, 21 nt, synthetic construct
  source 1..21: mol_type = other RNA
actcacctgtaataaattcgt

SEQ ID NO: 83 - RNA, 21 nt, synthetic construct
  source 1..21: mol_type = other RNA
ctcacctgtaataaattcgat

SEQ ID NO: 84 - RNA, 21 nt, synthetic construct
  source 1..21: mol_type = other RNA
acctgtaataaattcgacctt

SEQ ID NO: 85 - RNA, 21 nt, synthetic construct
  source 1..21: mol_type = other RNA
cctgtaataaattcgacctct

SEQ ID NO: 86 - RNA, 21 nt, synthetic construct
  source 1..21: mol_type = other RNA
ctgtaataaattcgacctcat

SEQ ID NO: 87 - RNA, 21 nt, synthetic construct
  source 1..21: mol_type = other RNA
acctcaaggtcaccataaaat

SEQ ID NO: 88 - RNA, 21 nt, synthetic construct
  source 1..21: mol_type = other RNA
cctcaaggtcaccataaaact

SEQ ID NO: 89 - RNA, 21 nt, synthetic construct
  source 1..21: mol_type = other RNA
tcaaggtcaccataaaaccat

SEQ ID NO: 90 - RNA, 21 nt, synthetic construct
  source 1..21: mol_type = other RNA
cagatacatctccaagtatgt

SEQ ID NO: 91 - RNA, 21 nt, synthetic construct
  source 1..21: mol_type = other RNA
tggacaaagccttctccgatt

SEQ ID NO: 92 - RNA, 21 nt, synthetic construct
  source 1..21: mol_type = other RNA
tctagctttcaaagttcacct

SEQ ID NO: 93 - RNA, 21 nt, synthetic construct
  source 1..21: mol_type = other RNA
ctagctttcaaagttcaccat

SEQ ID NO: 94 - RNA, 21 nt, synthetic construct
  source 1..21: mol_type = other RNA
agtcaaggtctacgcctattt

SEQ ID NO: 95 - RNA, 21 nt, synthetic construct
  source 1..21: mol_type = other RNA
caaggtctacgcctattacat

SEQ ID NO: 96 - RNA, 21 nt, synthetic construct
  source 1..21: mol_type = other RNA
aaggtctacgcctattacaat

SEQ ID NO: 97 - RNA, 21 nt, synthetic construct
  source 1..21: mol_type = other RNA
aggtctacgcctattacaact

SEQ ID NO: 98 - RNA, 21 nt, synthetic construct
  source 1..21: mol_type = other RNA
gtctacgcctattacaacctt

SEQ ID NO: 99 - RNA, 21 nt, synthetic construct
  source 1..21: mol_type = other RNA
tctacgcctattacaacctgt

SEQ ID NO: 100 - RNA, 21 nt, synthetic construct
  source 1..21: mol_type = other RNA
ggagtggactatgtgtacaat

SEQ ID NO: 101 - RNA, 21 nt, synthetic construct
  source 1..21: mol_type = other RNA
agtggactatgtgtacaagat

SEQ ID NO: 102 - RNA, 21 nt, synthetic construct
  source 1..21: mol_type = other RNA
gtggactatgtgtacaagact

SEQ ID NO: 103 - RNA, 21 nt, synthetic construct
  source 1..21: mol_type = other RNA
tggactatgtgtacaagacct

SEQ ID NO: 104 - RNA, 21 nt, synthetic construct
  source 1..21: mol_type = other RNA
agctgtccaatgactttgact

SEQ ID NO: 105 - RNA, 21 nt, synthetic construct
  source 1..21: mol_type = other RNA
gctgtccaatgactttgacgt

SEQ ID NO: 106 - RNA, 21 nt, synthetic construct
  source 1..21: mol_type = other RNA
gagaaccagaaacaatgccat

SEQ ID NO: 107 - RNA, 23 nt, synthetic construct
  source 1..23: mol_type = other RNA
atctggatgaagaggtacccgct

SEQ ID NO: 108 - RNA, 23 nt, synthetic construct
  source 1..23: mol_type = other RNA
  modified_base 7: mod_base = OTHER; note = 5'-methyluridine-3'-phosphate
actgtctggatgaagaggtaccc

SEQ ID NO: 109 - RNA, 23 nt, synthetic construct
  source 1..23: mol_type = other RNA
atctgtctggatgaagaggtacc

SEQ ID NO: 110 - RNA, 23 nt, synthetic construct
  source 1..23: mol_type = other RNA
  modified_base 7: mod_base = OTHER; note = 5'-methyluridine-3'-phosphate
atggtcttgtctgtctggatgaa

SEQ ID NO: 111 - RNA, 23 nt, synthetic construct
  source 1..23: mol_type = other RNA
aagatggtcttgtctgtctggat

SEQ ID NO: 112 - RNA, 23 nt, synthetic construct
  source 1..23: mol_type = other RNA
  modified_base 7: mod_base = OTHER; note = 5'-methyluridine-3'-phosphate
agtagatggtcttgtctgtctgg

SEQ ID NO: 113 - RNA, 23 nt, synthetic construct
  source 1..23: mol_type = other RNA
atgtagatggtcttgtctgtctg

SEQ ID NO: 114 - RNA, 23 nt, synthetic construct
  source 1..23: mol_type = other RNA
aatgttgacgagttccggaatgt

SEQ ID NO: 115 - RNA, 23 nt, synthetic construct
  source 1..23: mol_type = other RNA
accttcacctcaaactcagtgga

SEQ ID NO: 116 - RNA, 23 nt, synthetic construct
  source 1..23: mol_type = other RNA
atccttcacctcaaactcagtgg

SEQ ID NO: 117 - RNA, 23 nt, synthetic construct
  source 1..23: mol_type = other RNA
actatgacctcgaaactgggcag

SEQ ID NO: 118 - RNA, 23 nt, synthetic construct
  source 1..23: mol_type = other RNA
agttatagatgtagtagaatttc

SEQ ID NO: 119 - RNA, 23 nt, synthetic construct
  source 1..23: mol_type = other RNA
  modified_base 7: mod_base = OTHER; note = 5'-methyluridine-3'-phosphate
atgaagtggatctggtagggaga

SEQ ID NO: 120 - RNA, 23 nt, synthetic construct
  source 1..23: mol_type = other RNA
agtgaagtggatctggtagggag

SEQ ID NO: 121 - RNA, 23 nt, synthetic construct
  source 1..23: mol_type = other RNA
atggtgaagtggatctggtaggg

SEQ ID NO: 122 - RNA, 23 nt, synthetic construct
  source 1..23: mol_type = other RNA
attggtgaagtggatctggtagg

SEQ ID NO: 123 - RNA, 23 nt, synthetic construct
  source 1..23: mol_type = other RNA
atcttggtgaagtggatctggta

SEQ ID NO: 124 - RNA, 23 nt, synthetic construct
  source 1..23: mol_type = other RNA
  modified_base 7: mod_base = OTHER; note = 5'-methyluridine-3'-phosphate
aggtaattgttggagttgcccac

SEQ ID NO: 125 - RNA, 23 nt, synthetic construct
  source 1..23: mol_type = other RNA
acaggtaattgttggagttgccc

SEQ ID NO: 126 - RNA, 23 nt, synthetic construct
  source 1..23: mol_type = other RNA
  modified_base 7: mod_base = OTHER; note = 5'-methyluridine-3'-phosphate
agcaggtaattgttggagttgcc

SEQ ID NO: 127 - RNA, 23 nt, synthetic construct
  source 1..23: mol_type = other RNA
  modified_base 7: mod_base = OTHER; note = 5'-methyluridine-3'-phosphate
aagagatgcaggtaattgttgga

SEQ ID NO: 128 - RNA, 23 nt, synthetic construct
  source 1..23: mol_type = other RNA
  modified_base 7: mod_base = OTHER; note = 5'-methyluridine-3'-phosphate
aaggtgtagtagcggatcttggc

SEQ ID NO: 129 - RNA, 23 nt, synthetic construct
  source 1..23: mol_type = other RNA
  modified_base 7: mod_base = OTHER; note = 5'-methyluridine-3'-phosphate
atgttcttcttattcagcacgaa

SEQ ID NO: 130 - RNA, 23 nt, synthetic construct
  source 1..23: mol_type = other RNA
attgttcttcttattcagcacga

SEQ ID NO: 131 - RNA, 23 nt, synthetic construct
  source 1..23: mol_type = other RNA
  modified_base 7: mod_base = OTHER; note = 5'-methyluridine-3'-phosphate
aagatcttactctgcgtcagttt

SEQ ID NO: 132 - RNA, 23 nt, synthetic construct
  source 1..23: mol_type = other RNA
aaaacgatgttctcttctgcaat

SEQ ID NO: 133 - RNA, 23 nt, synthetic construct
  source 1..23: mol_type = other RNA
  modified_base 7: mod_base = OTHER; note = 5'-methyluridine-3'-phosphate
atccctttcttgtccgacatgct

SEQ ID NO: 134 - RNA, 23 nt, synthetic construct
  source 1..23: mol_type = other RNA
  modified_base 7: mod_base = OTHER; note = 5'-methyluridine-3'-phosphate
aatccctttcttgtccgacatgc

SEQ ID NO: 135 - RNA, 23 nt, synthetic construct
  source 1..23: mol_type = other RNA
aagatccctttcttgtccgacat

SEQ ID NO: 136 - RNA, 23 nt, synthetic construct
  source 1..23: mol_type = other RNA
  modified_base 7: mod_base = OTHER; note = 5'-methyluridine-3'-phosphate
aacagatccctttcttgtccgac

SEQ ID NO: 137 - RNA, 23 nt, synthetic construct
  source 1..23: mol_type = other RNA
aaagaagtcctgcattactgtga

SEQ ID NO: 138 - RNA, 23 nt, synthetic construct
  source 1..23: mol_type = other RNA
atgaagaagtcctgcattactgt

SEQ ID NO: 139 - RNA, 23 nt, synthetic construct
  source 1..23: mol_type = other RNA
aatgaagaagtcctgcattactg

SEQ ID NO: 140 - RNA, 23 nt, synthetic construct
  source 1..23: mol_type = other RNA
acgaacaacagagtagggtagcc

SEQ ID NO: 141 - RNA, 23 nt, synthetic construct
  source 1..23: mol_type = other RNA
atcgaacaacagagtagggtagc

SEQ ID NO: 142 - RNA, 23 nt, synthetic construct
  source 1..23: mol_type = other RNA
attcgaacaacagagtagggtag

SEQ ID NO: 143 - RNA, 23 nt, synthetic construct
  source 1..23: mol_type = other RNA
atttcgaacaacagagtagggta

SEQ ID NO: 144 - RNA, 23 nt, synthetic construct
  source 1..23: mol_type = other RNA
agtttcgaacaacagagtagggt

SEQ ID NO: 145 - RNA, 23 nt, synthetic construct
  source 1..23: mol_type = other RNA
acgtttcgaacaacagagtaggg

SEQ ID NO: 146 - RNA, 23 nt, synthetic construct
  source 1..23: mol_type = other RNA
  modified_base 7: mod_base = OTHER; note = 5'-methyluridine-3'-phosphate
atcgtttcgaacaacagagtagg

SEQ ID NO: 147 - RNA, 23 nt, synthetic construct
  source 1..23: mol_type = other RNA
  modified_base 7: mod_base = OTHER; note = 5'-methyluridine-3'-phosphate
actcgtttcgaacaacagagtag

SEQ ID NO: 148 - RNA, 23 nt, synthetic construct
  source 1..23: mol_type = other RNA
accggtaattgtagagaacggct

SEQ ID NO: 149 - RNA, 23 nt, synthetic construct
  source 1..23: mol_type = other RNA
  modified_base 7: mod_base = OTHER; note = 5'-methyluridine-3'-phosphate
agattgtggagtagttccaccct

SEQ ID NO: 150 - RNA, 23 nt, synthetic construct
  source 1..23: mol_type = other RNA
  modified_base 7: mod_base = OTHER; note = 5'-methyluridine-3'-phosphate
aaattctggtctcagactcggtg

SEQ ID NO: 151 - RNA, 23 nt, synthetic construct
  source 1..23: mol_type = other RNA
agtttcatccaggtaatgcacag

SEQ ID NO: 152 - RNA, 23 nt, synthetic construct
  source 1..23: mol_type = other RNA
aagaagaccttgaccacgtaggc

SEQ ID NO: 153 - RNA, 23 nt, synthetic construct
  source 1..23: mol_type = other RNA
agagagaagaccttgaccacgta

SEQ ID NO: 154 - RNA, 23 nt, synthetic construct
  source 1..23: mol_type = other RNA
aagagagaagaccttgaccacgt

SEQ ID NO: 155 - RNA, 23 nt, synthetic construct
  source 1..23: mol_type = other RNA
  modified_base 7: mod_base = OTHER; note = 5'-methyluridine-3'-phosphate
atcatttcttggtgtatcacggg

SEQ ID NO: 156 - RNA, 23 nt, synthetic construct
  source 1..23: mol_type = other RNA
  modified_base 7: mod_base = OTHER; note = 5'-methyluridine-3'-phosphate
acgagatgagaacaaaggccgtg

SEQ ID NO: 157 - RNA, 23 nt, synthetic construct
  source 1..23: mol_type = other RNA
atagttggcttcaaggaagtctc

SEQ ID NO: 158 - RNA, 23 nt, synthetic construct
  source 1..23: mol_type = other RNA
aatgtagttggcttcaaggaagt

SEQ ID NO: 159 - RNA, 23 nt, synthetic construct
  source 1..23: mol_type = other RNA
  modified_base 7: mod_base = OTHER; note = 5'-methyluridine-3'-phosphate
ataggttcatgtagttggcttca

SEQ ID NO: 160 - RNA, 23 nt, synthetic construct
  source 1..23: mol_type = other RNA
  modified_base 7: mod_base = OTHER; note = 5'-methyluridine-3'-phosphate
agtaggttcatgtagttggcttc

SEQ ID NO: 161 - RNA, 23 nt, synthetic construct
  source 1..23: mol_type = other RNA
atctgtaggttcatgtagttggc

SEQ ID NO: 162 - RNA, 23 nt, synthetic construct
  source 1..23: mol_type = other RNA
  modified_base 7: mod_base = OTHER; note = 5'-methyluridine-3'-phosphate
aatctttggctgtggtcagaaat

SEQ ID NO: 163 - RNA, 23 nt, synthetic construct
  source 1..23: mol_type = other RNA
agtcaaagtcttttagctgcagt

SEQ ID NO: 164 - RNA, 23 nt, synthetic construct
  source 1..23: mol_type = other RNA
  modified_base 7: mod_base = OTHER; note = 5'-methyluridine-3'-phosphate
agttcattgagccaacgcacgac

SEQ ID NO: 165 - RNA, 23 nt, synthetic construct
  source 1..23: mol_type = other RNA
  modified_base 7: mod_base = OTHER; note = 5'-methyluridine-3'-phosphate
aaaggcttggaacaccatgaagg

SEQ ID NO: 166 - RNA, 23 nt, synthetic construct
  source 1..23: mol_type = other RNA
attggtctcttctgatcgcagga

SEQ ID NO: 167 - RNA, 23 nt, synthetic construct
  source 1..23: mol_type = other RNA
  modified_base 7: mod_base = OTHER; note = 5'-methyluridine-3'-phosphate
acttggtctcttctgatcgcagg

SEQ ID NO: 168 - RNA, 23 nt, synthetic construct
  source 1..23: mol_type = other RNA
aaaaccctcattttccttggtct

SEQ ID NO: 169 - RNA, 23 nt, synthetic construct
  source 1..23: mol_type = other RNA
agtgaaaccctcattttccttgg

SEQ ID NO: 170 - RNA, 23 nt, synthetic construct
  source 1..23: mol_type = other RNA
  modified_base 7: mod_base = OTHER; note = 5'-methyluridine-3'-phosphate
acgaatttattacaggtgagttg

SEQ ID NO: 171 - RNA, 23 nt, synthetic construct
  source 1..23: mol_type = other RNA
  modified_base 7: mod_base = OTHER; note = 5'-methyluridine-3'-phosphate
atcgaatttattacaggtgagtt

SEQ ID NO: 172 - RNA, 23 nt, synthetic construct
  source 1..23: mol_type = other RNA
aaggtcgaatttattacaggtga

SEQ ID NO: 173 - RNA, 23 nt, synthetic construct
  source 1..23: mol_type = other RNA
agaggtcgaatttattacaggtg

SEQ ID NO: 174 - RNA, 23 nt, synthetic construct
  source 1..23: mol_type = other RNA
  modified_base 7: mod_base = OTHER; note = 5'-methyluridine-3'-phosphate
atgaggtcgaatttattacaggt

SEQ ID NO: 175 - RNA, 23 nt, synthetic construct
  source 1..23: mol_type = other RNA
  modified_base 7: mod_base = OTHER; note = 5'-methyluridine-3'-phosphate
attttatggtgaccttgaggtcg

SEQ ID NO: 176 - RNA, 23 nt, synthetic construct
  source 1..23: mol_type = other RNA
agttttatggtgaccttgaggtc

SEQ ID NO: 177 - RNA, 23 nt, synthetic construct
  source 1..23: mol_type = other RNA
  modified_base 7: mod_base = OTHER; note = 5'-methyluridine-3'-phosphate
atggttttatggtgaccttgagg

SEQ ID NO: 178 - RNA, 23 nt, synthetic construct
  source 1..23: mol_type = other RNA
  modified_base 7: mod_base = OTHER; note = 5'-methyluridine-3'-phosphate
acatacttggagatgtatctgtc

SEQ ID NO: 179 - RNA, 23 nt, synthetic construct
  source 1..23: mol_type = other RNA
aatcggagaaggctttgtccagc

SEQ ID NO: 180 - RNA, 23 nt, synthetic construct
  source 1..23: mol_type = other RNA
aggtgaactttgaaagctagaca

SEQ ID NO: 181 - RNA, 23 nt, synthetic construct
  source 1..23: mol_type = other RNA
atggtgaactttgaaagctagac

SEQ ID NO: 182 - RNA, 23 nt, synthetic construct
  source 1..23: mol_type = other RNA
aaataggcgtagaccttgactgc

SEQ ID NO: 183 - RNA, 23 nt, synthetic construct
  source 1..23: mol_type = other RNA
  modified_base 7: mod_base = OTHER; note = 5'-methyluridine-3'-phosphate
atgtaataggcgtagaccttgac

SEQ ID NO: 184 - RNA, 23 nt, synthetic construct
  source 1..23: mol_type = other RNA
attgtaataggcgtagaccttga

SEQ ID NO: 185 - RNA, 23 nt, synthetic construct
  source 1..23: mol_type = other RNA
agttgtaataggcgtagaccttg

SEQ ID NO: 186 - RNA, 23 nt, synthetic construct
  source 1..23: mol_type = other RNA
aaggttgtaataggcgtagacct

SEQ ID NO: 187 - RNA, 23 nt, synthetic construct
  source 1..23: mol_type = other RNA
  modified_base 7: mod_base = OTHER; note = 5'-methyluridine-3'-phosphate
acaggttgtaataggcgtagacc

SEQ ID NO: 188 - RNA, 23 nt, synthetic construct
  source 1..23: mol_type = other RNA
attgtacacatagtccactcctg

SEQ ID NO: 189 - RNA, 23 nt, synthetic construct
  source 1..23: mol_type = other RNA
  modified_base 7: mod_base = OTHER; note = 5'-methyluridine-3'-phosphate
atcttgtacacatagtccactcc

SEQ ID NO: 190 - RNA, 23 nt, synthetic construct
  source 1..23: mol_type = other RNA
agtcttgtacacatagtccactc

SEQ ID NO: 191 - RNA, 23 nt, synthetic construct
  source 1..23: mol_type = other RNA
  modified_base 7: mod_base = OTHER; note = 5'-methyluridine-3'-phosphate
aggtcttgtacacatagtccact

SEQ ID NO: 192 - RNA, 23 nt, synthetic construct
  source 1..23: mol_type = other RNA
agtcaaagtcattggacagctga

SEQ ID NO: 193 - RNA, 23 nt, synthetic construct
  source 1..23: mol_type = other RNA
acgtcaaagtcattggacagctg

SEQ ID NO: 194 - RNA, 23 nt, synthetic construct
  source 1..23: mol_type = other RNA
  modified_base 7: mod_base = OTHER; note = 5'-methyluridine-3'-phosphate
atggcattgtttctggttctctt

SEQ ID NO: 195 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
cgggtacctcttcatccagat

SEQ ID NO: 196 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine
gtacctcttcatccagacagt

SEQ ID NO: 197 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
tacctcttcatccagacagat

SEQ ID NO: 198 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
catccagacagacaagaccat

SEQ ID NO: 199 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
ccagacagacaagaccatctt

SEQ ID NO: 200 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
agacagacaagaccatctact

SEQ ID NO: 201 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
gacagacaagaccatctacat

SEQ ID NO: 202 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
attccggaactcgtcaacatt

SEQ ID NO: 203 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine
cactgagtttgaggtgaaggt

SEQ ID NO: 204 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
actgagtttgaggtgaaggat

SEQ ID NO: 205 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine
gcccagtttcgaggtcatagt

SEQ ID NO: 206 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
aattctactacatctataact

SEQ ID NO: 207 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
tccctaccagatccacttcat

SEQ ID NO: 208 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
ccctaccagatccacttcact

SEQ ID NO: 209 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
ctaccagatccacttcaccat

SEQ ID NO: 210 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
taccagatccacttcaccaat

SEQ ID NO: 211 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
ccagatccacttcaccaagat

SEQ ID NO: 212 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine
gggcaactccaacaattacct

SEQ ID NO: 213 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine
gcaactccaacaattacctgt

SEQ ID NO: 214 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine
caactccaacaattacctgct

SEQ ID NO: 215 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
caacaattacctgcatctctt

SEQ ID NO: 216 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
caagatccgctactacacctt

SEQ ID NO: 217 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
cgtgctgaataagaagaacat

SEQ ID NO: 218 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
gtgctgaataagaagaacaat

SEQ ID NO: 219 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
actgacgcagagtaagatctt

SEQ ID NO: 220 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine
tgcagaagagaacatcgtttt

SEQ ID NO: 221 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
catgtcggacaagaaagggat

SEQ ID NO: 222 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
atgtcggacaagaaagggatt

SEQ ID NO: 223 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
gtcggacaagaaagggatctt

SEQ ID NO: 224 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine
cggacaagaaagggatctgtt

SEQ ID NO: 225 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine
acagtaatgcaggacttcttt

SEQ ID NO: 226 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
agtaatgcaggacttcttcat

SEQ ID NO: 227 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
gtaatgcaggacttcttcatt

SEQ ID NO: 228 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine
ctaccctactctgttgttcgt

SEQ ID NO: 229 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
taccctactctgttgttcgat

SEQ ID NO: 230 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
accctactctgttgttcgaat

SEQ ID NO: 231 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
ccctactctgttgttcgaaat

SEQ ID NO: 232 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
cctactctgttgttcgaaact

SEQ ID NO: 233 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine
ctactctgttgttcgaaacgt

SEQ ID NO: 234 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
tactctgttgttcgaaacgat

SEQ ID NO: 235 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine
actctgttgttcgaaacgagt

SEQ ID NO: 236 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine
ccgttctctacaattaccggt

SEQ ID NO: 237 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine
ggtggaactactccacaatct

SEQ ID NO: 238 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine
ccgagtctgagaccagaattt

SEQ ID NO: 239 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
gtgcattacctggatgaaact

SEQ ID NO: 240 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
ctacgtggtcaaggtcttctt

SEQ ID NO: 241 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine
cgtggtcaaggtcttctctct

SEQ ID NO: 242 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
gtggtcaaggtcttctctctt

SEQ ID NO: 243 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
cgtgatacaccaagaaatgat

SEQ ID NO: 244 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine
cggcctttgttctcatctcgt

SEQ ID NO: 245 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine
gacttccttgaagccaactat

SEQ ID NO: 246 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
ttccttgaagccaactacatt

SEQ ID NO: 247 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine
aagccaactacatgaacctat

SEQ ID NO: 248 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
agccaactacatgaacctact

SEQ ID NO: 249 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
caactacatgaacctacagat

SEQ ID NO: 250 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
ttctgaccacagccaaagatt

SEQ ID NO: 251 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
tgcagctaaaagactttgact

SEQ ID NO: 252 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
cgtgcgttggctcaatgaact

SEQ ID NO: 253 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine
ttcatggtgttccaagccttt

SEQ ID NO: 254 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
ctgcgatcagaagagaccaat

SEQ ID NO: 255 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine
tgcgatcagaagagaccaagt

SEQ ID NO: 256 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine
accaaggaaaatgagggtttt

SEQ ID NO: 257 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
aaggaaaatgagggtttcact

SEQ ID NO: 258 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine
actcacctgtaataaattcgt

SEQ ID NO: 259 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
ctcacctgtaataaattcgat

SEQ ID NO: 260 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
acctgtaataaattcgacctt

SEQ ID NO: 261 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine
cctgtaataaattcgacctct

SEQ ID NO: 262 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
ctgtaataaattcgacctcat

SEQ ID NO: 263 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
acctcaaggtcaccataaaat

SEQ ID NO: 264 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
cctcaaggtcaccataaaact

SEQ ID NO: 265 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
tcaaggtcaccataaaaccat

SEQ ID NO: 266 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine
cagatacatctccaagtatgt

SEQ ID NO: 267 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
tggacaaagccttctccgatt

SEQ ID NO: 268 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine
tctagctttcaaagttcacct

SEQ ID NO: 269 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
ctagctttcaaagttcaccat

SEQ ID NO: 270 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine
agtcaaggtctacgcctattt

SEQ ID NO: 271 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
caaggtctacgcctattacat

SEQ ID NO: 272 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
aaggtctacgcctattacaat

SEQ ID NO: 273 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
aggtctacgcctattacaact

SEQ ID NO: 274 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
gtctacgcctattacaacctt

SEQ ID NO: 275 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine
tctacgcctattacaacctgt

SEQ ID NO: 276 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
ggagtggactatgtgtacaat

SEQ ID NO: 277 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
agtggactatgtgtacaagat

SEQ ID NO: 278 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
gtggactatgtgtacaagact

SEQ ID NO: 279 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine
tggactatgtgtacaagacct

SEQ ID NO: 280 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
agctgtccaatgactttgact

SEQ ID NO: 281 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine
gctgtccaatgactttgacgt

SEQ ID NO: 282 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
gagaaccagaaacaatgccat

SEQ ID NO: 283 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
atctggatgaagaggtacccgct

SEQ ID NO: 284 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
actgtctggatgaagaggtaccc

SEQ ID NO: 285 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Cytidine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
atctgtctggatgaagaggtacc

SEQ ID NO: 286 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
atggtcttgtctgtctggatgaa

SEQ ID NO: 287 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagatggtcttgtctgtctggat

SEQ ID NO: 288 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
agtagatggtcttgtctgtctgg

SEQ ID NO: 289 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
atgtagatggtcttgtctgtctg

SEQ ID NO: 290 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aatgttgacgagttccggaatgt

SEQ ID NO: 291 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
accttcacctcaaactcagtgga

SEQ ID NO: 292 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atccttcacctcaaactcagtgg

SEQ ID NO: 293 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
actatgacctcgaaactgggcag

SEQ ID NO: 294 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agttatagatgtagtagaatttc

SEQ ID NO: 295 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
atgaagtggatctggtagggaga

SEQ ID NO: 296 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
agtgaagtggatctggtagggag

SEQ ID NO: 297 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atggtgaagtggatctggtaggg

SEQ ID NO: 298 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
attggtgaagtggatctggtagg

SEQ ID NO: 299 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
atcttggtgaagtggatctggta

SEQ ID NO: 300 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
aggtaattgttggagttgcccac

SEQ ID NO: 301 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
acaggtaattgttggagttgccc

SEQ ID NO: 302 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
agcaggtaattgttggagttgcc

SEQ ID NO: 303 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aagagatgcaggtaattgttgga

SEQ ID NO: 304 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aaggtgtagtagcggatcttggc

SEQ ID NO: 305 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
atgttcttcttattcagcacgaa

SEQ ID NO: 306 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
attgttcttcttattcagcacga

SEQ ID NO: 307 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
aagatcttactctgcgtcagttt

SEQ ID NO: 308 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aaaacgatgttctcttctgcaat

SEQ ID NO: 309 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
atccctttcttgtccgacatgct

SEQ ID NO: 310 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aatccctttcttgtccgacatgc

SEQ ID NO: 311 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aagatccctttcttgtccgacat

SEQ ID NO: 312 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
aacagatccctttcttgtccgac

SEQ ID NO: 313 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aaagaagtcctgcattactgtga

SEQ ID NO: 314 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
atgaagaagtcctgcattactgt

SEQ ID NO: 315 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Guanosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aatgaagaagtcctgcattactg

SEQ ID NO: 316 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
acgaacaacagagtagggtagcc

SEQ ID NO: 317 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Cytidine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
atcgaacaacagagtagggtagc

SEQ ID NO: 318 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
attcgaacaacagagtagggtag

SEQ ID NO: 319 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
atttcgaacaacagagtagggta

SEQ ID NO: 320 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Guanosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agtttcgaacaacagagtagggt

SEQ ID NO: 321 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
acgtttcgaacaacagagtaggg

SEQ ID NO: 322 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atcgtttcgaacaacagagtagg

SEQ ID NO: 323 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
actcgtttcgaacaacagagtag

SEQ ID NO: 324 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
accggtaattgtagagaacggct

SEQ ID NO: 325 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
agattgtggagtagttccaccct

SEQ ID NO: 326 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaattctggtctcagactcggtg

SEQ ID NO: 327 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
agtttcatccaggtaatgcacag

SEQ ID NO: 328 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aagaagaccttgaccacgtaggc

SEQ ID NO: 329 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
agagagaagaccttgaccacgta

SEQ ID NO: 330 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aagagagaagaccttgaccacgt

SEQ ID NO: 331 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atcatttcttggtgtatcacggg

SEQ ID NO: 332 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
acgagatgagaacaaaggccgtg

SEQ ID NO: 333 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
atagttggcttcaaggaagtctc

SEQ ID NO: 334 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aatgtagttggcttcaaggaagt

SEQ ID NO: 335 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ataggttcatgtagttggcttca

SEQ ID NO: 336 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agtaggttcatgtagttggcttc

SEQ ID NO: 337 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
atctgtaggttcatgtagttggc

SEQ ID NO: 338 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aatctttggctgtggtcagaaat

SEQ ID NO: 339 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agtcaaagtcttttagctgcagt

SEQ ID NO: 340 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
agttcattgagccaacgcacgac

SEQ ID NO: 341 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
aaaggcttggaacaccatgaagg

SEQ ID NO: 342 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Cytidine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
attggtctcttctgatcgcagga

SEQ ID NO: 343 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
acttggtctcttctgatcgcagg

SEQ ID NO: 344 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Cytidine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aaaaccctcattttccttggtct

SEQ ID NO: 345 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
agtgaaaccctcattttccttgg

SEQ ID NO: 346 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
acgaatttattacaggtgagttg

SEQ ID NO: 347 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
atcgaatttattacaggtgagtt

SEQ ID NO: 348 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Guanosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aaggtcgaatttattacaggtga

SEQ ID NO: 349 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Cytidine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
agaggtcgaatttattacaggtg

SEQ ID NO: 350 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
atgaggtcgaatttattacaggt

SEQ ID NO: 351 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
attttatggtgaccttgaggtcg

SEQ ID NO: 352 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agttttatggtgaccttgaggtc

SEQ ID NO: 353 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atggttttatggtgaccttgagg

SEQ ID NO: 354 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
acatacttggagatgtatctgtc

SEQ ID NO: 355 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aatcggagaaggctttgtccagc

SEQ ID NO: 356 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aggtgaactttgaaagctagaca

SEQ ID NO: 357 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
atggtgaactttgaaagctagac

SEQ ID NO: 358 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aaataggcgtagaccttgactgc

SEQ ID NO: 359 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
atgtaataggcgtagaccttgac

SEQ ID NO: 360 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
attgtaataggcgtagaccttga

SEQ ID NO: 361 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
agttgtaataggcgtagaccttg

SEQ ID NO: 362 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aaggttgtaataggcgtagacct

SEQ ID NO: 363 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
acaggttgtaataggcgtagacc

SEQ ID NO: 364 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Cytidine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
attgtacacatagtccactcctg

SEQ ID NO: 365 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
atcttgtacacatagtccactcc

SEQ ID NO: 366 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agtcttgtacacatagtccactc

SEQ ID NO: 367 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aggtcttgtacacatagtccact

SEQ ID NO: 368 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
agtcaaagtcattggacagctga

SEQ ID NO: 369 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
acgtcaaagtcattggacagctg

SEQ ID NO: 370 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
atggcattgtttctggttctctt

SEQ ID NO: 371 - RNA, 23 nt, synthetic construct
  source 1..23: mol_type = other RNA
agcgggtacctcttcatccagac

SEQ ID NO: 372 - RNA, 23 nt, synthetic construct
  source 1..23: mol_type = other RNA
gggtacctcttcatccagacaga

SEQ ID NO: 373 - RNA, 23 nt, synthetic construct
  source 1..23: mol_type = other RNA
ggtacctcttcatccagacagac

SEQ ID NO: 374 - RNA, 23 nt, synthetic construct
  source 1..23: mol_type = other RNA
ttcatccagacagacaagaccat

SEQ ID NO: 375 - RNA, 23 nt, synthetic construct
  source 1..23: mol_type = other RNA
atccagacagacaagaccatcta

SEQ ID NO: 376 - RNA, 23 nt, synthetic construct
  source 1..23: mol_type = other RNA
ccagacagacaagaccatctaca

SEQ ID NO: 377 - RNA, 23 nt, synthetic construct
  source 1..23: mol_type = other RNA
cagacagacaagaccatctacac

SEQ ID NO: 378 - RNA, 23 nt, synthetic construct
  source 1..23: mol_type = other RNA
acattccggaactcgtcaacatg

SEQ ID NO: 379 - RNA, 23 nt, synthetic construct
  source 1..23: mol_type = other RNA
tccactgagtttgaggtgaagga

SEQ ID NO: 380 - RNA, 23 nt, synthetic construct
  source 1..23: mol_type = other RNA
ccactgagtttgaggtgaaggag

SEQ ID NO: 381 - RNA, 23 nt, synthetic construct
  source 1..23: mol_type = other RNA
ctgcccagtttcgaggtcatagt

SEQ ID NO: 382 - RNA, 23 nt, synthetic construct
  source 1..23: mol_type = other RNA
gaaattctactacatctataacg

SEQ ID NO: 383 - RNA, 23 nt, synthetic construct
  source 1..23: mol_type = other RNA
tctccctaccagatccacttcac

SEQ ID NO: 384 - RNA, 23 nt, synthetic construct
  source 1..23: mol_type = other RNA
ctccctaccagatccacttcacc

SEQ ID NO: 385 - RNA, 23 nt, synthetic construct
  source 1..23: mol_type = other RNA
ccctaccagatccacttcaccaa

SEQ ID NO: 386 - RNA, 23 nt, synthetic construct
  source 1..23: mol_type = other RNA
cctaccagatccacttcaccaag

SEQ ID NO: 387 - RNA, 23 nt, synthetic construct
  source 1..23: mol_type = other RNA
taccagatccacttcaccaagac

SEQ ID NO: 388 - RNA, 23 nt, synthetic construct
  source 1..23: mol_type = other RNA
gtgggcaactccaacaattacct

SEQ ID NO: 389 - RNA, 23 nt, synthetic construct
  source 1..23: mol_type = other RNA
gggcaactccaacaattacctgc

SEQ ID NO: 390 - RNA, 23 nt, synthetic construct
  source 1..23: mol_type = other RNA
ggcaactccaacaattacctgca

SEQ ID NO: 391 - RNA, 23 nt, synthetic construct
  source 1..23: mol_type = other RNA
tccaacaattacctgcatctctc

SEQ ID NO: 392 - RNA, 23 nt, synthetic construct
  source 1..23: mol_type = other RNA
gccaagatccgctactacaccta

SEQ ID NO: 393 - RNA, 23 nt, synthetic construct
  source 1..23: mol_type = other RNA
ttcgtgctgaataagaagaacaa

SEQ ID NO: 394 - RNA, 23 nt, synthetic construct
  source 1..23: mol_type = other RNA
tcgtgctgaataagaagaacaaa

SEQ ID NO: 395 - RNA, 23 nt, synthetic construct
  source 1..23: mol_type = other RNA
aaactgacgcagagtaagatctg

SEQ ID NO: 396 - RNA, 23 nt, synthetic construct
  source 1..23: mol_type = other RNA
attgcagaagagaacatcgtttc

SEQ ID NO: 397 - RNA, 23 nt, synthetic construct
  source 1..23: mol_type = other RNA
agcatgtcggacaagaaagggat

SEQ ID NO: 398 - RNA, 23 nt, synthetic construct
  source 1..23: mol_type = other RNA
gcatgtcggacaagaaagggatc

SEQ ID NO: 399 - RNA, 23 nt, synthetic construct
  source 1..23: mol_type = other RNA
atgtcggacaagaaagggatctg

SEQ ID NO: 400 - RNA, 23 nt, synthetic construct
  source 1..23: mol_type = other RNA
gtcggacaagaaagggatctgtg

SEQ ID NO: 401 - RNA, 23 nt, synthetic construct
  source 1..23: mol_type = other RNA
tcacagtaatgcaggacttcttc

SEQ ID NO: 402 - RNA, 23 nt, synthetic construct
  source 1..23: mol_type = other RNA
acagtaatgcaggacttcttcat

SEQ ID NO: 403 - RNA, 23 nt, synthetic construct
  source 1..23: mol_type = other RNA
cagtaatgcaggacttcttcatc

SEQ ID NO: 404 - RNA, 23 nt, synthetic construct
  source 1..23: mol_type = other RNA
ggctaccctactctgttgttcga

SEQ ID NO: 405 - RNA, 23 nt, synthetic construct
  source 1..23: mol_type = other RNA
gctaccctactctgttgttcgaa

SEQ ID NO: 406 - RNA, 23 nt, synthetic construct
  source 1..23: mol_type = other RNA
ctaccctactctgttgttcgaaa

SEQ ID NO: 407 - RNA, 23 nt, synthetic construct
  source 1..23: mol_type = other RNA
taccctactctgttgttcgaaac

SEQ ID NO: 408 - RNA, 23 nt, synthetic construct
  source 1..23: mol_type = other RNA
accctactctgttgttcgaaacg

SEQ ID NO: 409 - RNA, 23 nt, synthetic construct
  source 1..23: mol_type = other RNA
ccctactctgttgttcgaaacga

SEQ ID NO: 410 - RNA, 23 nt, synthetic construct
  source 1..23: mol_type = other RNA
cctactctgttgttcgaaacgag

SEQ ID NO: 411 - RNA, 23 nt, synthetic construct
  source 1..23: mol_type = other RNA
ctactctgttgttcgaaacgagc

SEQ ID NO: 412 - RNA, 23 nt, synthetic construct
  source 1..23: mol_type = other RNA
agccgttctctacaattaccggc

SEQ ID NO: 413 - RNA, 23 nt, synthetic construct
  source 1..23: mol_type = other RNA
agggtggaactactccacaatcc

SEQ ID NO: 414 - RNA, 23 nt, synthetic construct
  source 1..23: mol_type = other RNA
caccgagtctgagaccagaattc

SEQ ID NO: 415 - RNA, 23 nt, synthetic construct
  source 1..23: mol_type = other RNA
ctgtgcattacctggatgaaacg

SEQ ID NO: 416 - RNA, 23 nt, synthetic construct
  source 1..23: mol_type = other RNA
gcctacgtggtcaaggtcttctc

SEQ ID NO: 417 - RNA, 23 nt, synthetic construct
  source 1..23: mol_type = other RNA
tacgtggtcaaggtcttctctct

SEQ ID NO: 418 - RNA, 23 nt, synthetic construct
  source 1..23: mol_type = other RNA
acgtggtcaaggtcttctctctg

SEQ ID NO: 419 - RNA, 23 nt, synthetic construct
  source 1..23: mol_type = other RNA
cccgtgatacaccaagaaatgat

SEQ ID NO: 420 - RNA, 23 nt, synthetic construct
  source 1..23: mol_type = other RNA
cacggcctttgttctcatctcgc

SEQ ID NO: 421 - RNA, 23 nt, synthetic construct
  source 1..23: mol_type = other RNA
gagacttccttgaagccaactac

SEQ ID NO: 422 - RNA, 23 nt, synthetic construct
  source 1..23: mol_type = other RNA
acttccttgaagccaactacatg

SEQ ID NO: 423 - RNA, 23 nt, synthetic construct
  source 1..23: mol_type = other RNA
tgaagccaactacatgaacctac

SEQ ID NO: 424 - RNA, 23 nt, synthetic construct
  source 1..23: mol_type = other RNA
gaagccaactacatgaacctaca

SEQ ID NO: 425 - RNA, 23 nt, synthetic construct
  source 1..23: mol_type = other RNA
gccaactacatgaacctacagag

SEQ ID NO: 426 - RNA, 23 nt, synthetic construct
  source 1..23: mol_type = other RNA
atttctgaccacagccaaagata

SEQ ID NO: 427 - RNA, 23 nt, synthetic construct
  source 1..23: mol_type = other RNA
actgcagctaaaagactttgact

SEQ ID NO: 428 - RNA, 23 nt, synthetic construct
  source 1..23: mol_type = other RNA
gtcgtgcgttggctcaatgaaca

SEQ ID NO: 429 - RNA, 23 nt, synthetic construct
  source 1..23: mol_type = other RNA
ccttcatggtgttccaagccttg

SEQ ID NO: 430 - RNA, 23 nt, synthetic construct
  source 1..23: mol_type = other RNA
tcctgcgatcagaagagaccaag

SEQ ID NO: 431 - RNA, 23 nt, synthetic construct
  source 1..23: mol_type = other RNA
cctgcgatcagaagagaccaagg

SEQ ID NO: 432 - RNA, 23 nt, synthetic construct
  source 1..23: mol_type = other RNA
agaccaaggaaaatgagggtttc

SEQ ID NO: 433 - RNA, 23 nt, synthetic construct
  source 1..23: mol_type = other RNA
ccaaggaaaatgagggtttcaca

SEQ ID NO: 434 - RNA, 23 nt, synthetic construct
  source 1..23: mol_type = other RNA
caactcacctgtaataaattcga

SEQ ID NO: 435 - RNA, 23 nt, synthetic construct
  source 1..23: mol_type = other RNA
aactcacctgtaataaattcgac

SEQ ID NO: 436 - RNA, 23 nt, synthetic construct
  source 1..23: mol_type = other RNA
tcacctgtaataaattcgacctc

SEQ ID NO: 437 - RNA, 23 nt, synthetic construct
  source 1..23: mol_type = other RNA
cacctgtaataaattcgacctca

SEQ ID NO: 438 - RNA, 23 nt, synthetic construct
  source 1..23: mol_type = other RNA
acctgtaataaattcgacctcaa

SEQ ID NO: 439 - RNA, 23 nt, synthetic construct
  source 1..23: mol_type = other RNA
cgacctcaaggtcaccataaaac

SEQ ID NO: 440 - RNA, 23 nt, synthetic construct
  source 1..23: mol_type = other RNA
gacctcaaggtcaccataaaacc

SEQ ID NO: 441 - RNA, 23 nt, synthetic construct
  source 1..23: mol_type = other RNA
cctcaaggtcaccataaaaccag

SEQ ID NO: 442 - RNA, 23 nt, synthetic construct
  source 1..23: mol_type = other RNA
gacagatacatctccaagtatga

SEQ ID NO: 443 - RNA, 23 nt, synthetic construct
  source 1..23: mol_type = other RNA
gctggacaaagccttctccgata

SEQ ID NO: 444 - RNA, 23 nt, synthetic construct
  source 1..23: mol_type = other RNA
tgtctagctttcaaagttcacca

SEQ ID NO: 445 - RNA, 23 nt, synthetic construct
  source 1..23: mol_type = other RNA
gtctagctttcaaagttcaccaa

SEQ ID NO: 446 - RNA, 23 nt, synthetic construct
  source 1..23: mol_type = other RNA
gcagtcaaggtctacgcctatta

SEQ ID NO: 447 - RNA, 23 nt, synthetic construct
  source 1..23: mol_type = other RNA
gtcaaggtctacgcctattacaa

SEQ ID NO: 448 - RNA, 23 nt, synthetic construct
  source 1..23: mol_type = other RNA
tcaaggtctacgcctattacaac

SEQ ID NO: 449 - RNA, 23 nt, synthetic construct
  source 1..23: mol_type = other RNA
caaggtctacgcctattacaacc

SEQ ID NO: 450 - RNA, 23 nt, synthetic construct
  source 1..23: mol_type = other RNA
aggtctacgcctattacaacctg

SEQ ID NO: 451 - RNA, 23 nt, synthetic construct
  source 1..23: mol_type = other RNA
ggtctacgcctattacaacctgg

SEQ ID NO: 452 - RNA, 23 nt, synthetic construct
  source 1..23: mol_type = other RNA
caggagtggactatgtgtacaag

SEQ ID NO: 453 - RNA, 23 nt, synthetic construct
  source 1..23: mol_type = other RNA
ggagtggactatgtgtacaagac

SEQ ID NO: 454 - RNA, 23 nt, synthetic construct
  source 1..23: mol_type = other RNA
gagtggactatgtgtacaagacc

SEQ ID NO: 455 - RNA, 23 nt, synthetic construct
  source 1..23: mol_type = other RNA
agtggactatgtgtacaagaccc

SEQ ID NO: 456 - RNA, 23 nt, synthetic construct
  source 1..23: mol_type = other RNA
tcagctgtccaatgactttgacg

SEQ ID NO: 457 - RNA, 23 nt, synthetic construct
  source 1..23: mol_type = other RNA
cagctgtccaatgactttgacga

SEQ ID NO: 458 - RNA, 23 nt, synthetic construct
  source 1..23: mol_type = other RNA
aagagaaccagaaacaatgccag

SEQ ID NO: 459 - RNA, 21 nt, synthetic construct
  source 1..21: mol_type = other RNA
acggtcatggtcaacattgat

SEQ ID NO: 460 - RNA, 21 nt, synthetic construct
  source 1..21: mol_type = other RNA
agatccgagcctactatgaat

SEQ ID NO: 461 - RNA, 21 nt, synthetic construct
  source 1..21: mol_type = other RNA
gatccgagcctactatgaaat

SEQ ID NO: 462 - RNA, 21 nt, synthetic construct
  source 1..21: mol_type = other RNA
tgggcaactccaacaattact

SEQ ID NO: 463 - RNA, 21 nt, synthetic construct
  source 1..21: mol_type = other RNA
ggcaactccaacaattacctt

SEQ ID NO: 464 - RNA, 21 nt, synthetic construct
  source 1..21: mol_type = other RNA
cgtgttcgtgctgaataagat

SEQ ID NO: 465 - RNA, 21 nt, synthetic construct
  source 1..21: mol_type = other RNA
tgttcgtgctgaataagaagt

SEQ ID NO: 466 - RNA, 21 nt, synthetic construct
  source 1..21: mol_type = other RNA
gttcgtgctgaataagaagat

SEQ ID NO: 467 - RNA, 21 nt, synthetic construct
  source 1..21: mol_type = other RNA
ttcgtgctgaataagaagaat

SEQ ID NO: 468 - RNA, 21 nt, synthetic construct
  source 1..21: mol_type = other RNA
tccgagccgttctctacaatt

SEQ ID NO: 469 - RNA, 21 nt, synthetic construct
  source 1..21: mol_type = other RNA
ccgagccgttctctacaattt

SEQ ID NO: 470 - RNA, 21 nt, synthetic construct
  source 1..21: mol_type = other RNA
cgagccgttctctacaattat

SEQ ID NO: 471 - RNA, 21 nt, synthetic construct
  source 1..21: mol_type = other RNA
gagccgttctctacaattact

SEQ ID NO: 472 - RNA, 21 nt, synthetic construct
  source 1..21: mol_type = other RNA
gcctcttcttaacaaatttct

SEQ ID NO: 473 - RNA, 21 nt, synthetic construct
  source 1..21: mol_type = other RNA
ccacagccaaagataagaact

SEQ ID NO: 474 - RNA, 21 nt, synthetic construct
  source 1..21: mol_type = other RNA
ctactgcagctaaaagacttt

SEQ ID NO: 475 - RNA, 21 nt, synthetic construct
  source 1..21: mol_type = other RNA
tcgtgcgttggctcaatgaat

SEQ ID NO: 476 - RNA, 21 nt, synthetic construct
  source 1..21: mol_type = other RNA
gtgcgttggctcaatgaacat

SEQ ID NO: 477 - RNA, 21 nt, synthetic construct
  source 1..21: mol_type = other RNA
agccttggctcaataccaaat

SEQ ID NO: 478 - RNA, 21 nt, synthetic construct
  source 1..21: mol_type = other RNA
aactcacctgtaataaattct

SEQ ID NO: 479 - RNA, 21 nt, synthetic construct
  source 1..21: mol_type = other RNA
gacctcaaggtcaccataaat

SEQ ID NO: 480 - RNA, 21 nt, synthetic construct
  source 1..21: mol_type = other RNA
ctcaaggtcaccataaaacct

SEQ ID NO: 481 - RNA, 21 nt, synthetic construct
  source 1..21: mol_type = other RNA
gatgccaagaacactatgatt

SEQ ID NO: 482 - RNA, 21 nt, synthetic construct
  source 1..21: mol_type = other RNA
aggatgccactatgtctatat

SEQ ID NO: 483 - RNA, 23 nt, synthetic construct
  source 1..23: mol_type = other RNA
atcaatgttgaccatgaccgtcc

SEQ ID NO: 484 - RNA, 23 nt, synthetic construct
  source 1..23: mol_type = other RNA
attcatagtaggctcggatcttc

SEQ ID NO: 485 - RNA, 23 nt, synthetic construct
  source 1..23: mol_type = other RNA
atttcatagtaggctcggatctt

SEQ ID NO: 486 - RNA, 23 nt, synthetic construct
  source 1..23: mol_type = other RNA
agtaattgttggagttgcccacg

SEQ ID NO: 487 - RNA, 23 nt, synthetic construct
  source 1..23: mol_type = other RNA
aaggtaattgttggagttgccca

SEQ ID NO: 488 - RNA, 23 nt, synthetic construct
  source 1..23: mol_type = other RNA
atcttattcagcacgaacacgcc

SEQ ID NO: 489 - RNA, 23 nt, synthetic construct
  source 1..23: mol_type = other RNA
acttcttattcagcacgaacacg

SEQ ID NO: 490 - RNA, 23 nt, synthetic construct
  source 1..23: mol_type = other RNA
atcttcttattcagcacgaacac

SEQ ID NO: 491 - RNA, 23 nt, synthetic construct
  source 1..23: mol_type = other RNA
attcttcttattcagcacgaaca

SEQ ID NO: 492 - RNA, 23 nt, synthetic construct
  source 1..23: mol_type = other RNA
aagatcttactctgcgtcagttt

SEQ ID NO: 493 - RNA, 23 nt, synthetic construct
  source 1..23: mol_type = other RNA
aattgtagagaacggctcggatt

SEQ ID NO: 494 - RNA, 23 nt, synthetic construct
  source 1..23: mol_type = other RNA
aaattgtagagaacggctcggat

SEQ ID NO: 495 - RNA, 23 nt, synthetic construct
  source 1..23: mol_type = other RNA
ataattgtagagaacggctcgga

SEQ ID NO: 496 - RNA, 23 nt, synthetic construct
  source 1..23: mol_type = other RNA
agtaattgtagagaacggctcgg

SEQ ID NO: 497 - RNA, 23 nt, synthetic construct
  source 1..23: mol_type = other RNA
agaaatttgttaagaagaggccc

SEQ ID NO: 498 - RNA, 23 nt, synthetic construct
  source 1..23: mol_type = other RNA
agttcttatctttggctgtggtc

SEQ ID NO: 499 - RNA, 23 nt, synthetic construct
  source 1..23: mol_type = other RNA
aaagtcttttagctgcagtaggg

SEQ ID NO: 500 - RNA, 23 nt, synthetic construct
  source 1..23: mol_type = other RNA
attcattgagccaacgcacgacg

SEQ ID NO: 501 - RNA, 23 nt, synthetic construct
  source 1..23: mol_type = other RNA
atgttcattgagccaacgcacga

SEQ ID NO: 502 - RNA, 23 nt, synthetic construct
  source 1..23: mol_type = other RNA
atttggtattgagccaaggcttg

SEQ ID NO: 503 - RNA, 23 nt, synthetic construct
  source 1..23: mol_type = other RNA
agaatttattacaggtgagttga

SEQ ID NO: 504 - RNA, 23 nt, synthetic construct
  source 1..23: mol_type = other RNA
acgaatttattacaggtgagttg

SEQ ID NO: 505 - RNA, 23 nt, synthetic construct
  source 1..23: mol_type = other RNA
atcgaatttattacaggtgagtt

SEQ ID NO: 506 - RNA, 23 nt, synthetic construct
  source 1..23: mol_type = other RNA
atttatggtgaccttgaggtcga

SEQ ID NO: 507 - RNA, 23 nt, synthetic construct
  source 1..23: mol_type = other RNA
aggttttatggtgaccttgaggt

SEQ ID NO: 508 - RNA, 23 nt, synthetic construct
  source 1..23: mol_type = other RNA
atggttttatggtgaccttgagg

SEQ ID NO: 509 - RNA, 23 nt, synthetic construct
  source 1..23: mol_type = other RNA
aatcatagtgttcttggcatcct

SEQ ID NO: 510 - RNA, 23 nt, synthetic construct
  source 1..23: mol_type = other RNA
atatagacatagtggcatcctgg

SEQ ID NO: 511 - RNA, 23 nt, synthetic construct
  source 1..23: mol_type = other RNA
atgtaataggcgtagaccttgac

SEQ ID NO: 512 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
acggtcatggtcaacattgat

SEQ ID NO: 513 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
agatccgagcctactatgaat

SEQ ID NO: 514 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
gatccgagcctactatgaaat

SEQ ID NO: 515 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
tgggcaactccaacaattact

SEQ ID NO: 516 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
ggcaactccaacaattacctt

SEQ ID NO: 517 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
cgtgttcgtgctgaataagat

SEQ ID NO: 518 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine
tgttcgtgctgaataagaagt

SEQ ID NO: 519 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
gttcgtgctgaataagaagat

SEQ ID NO: 520 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
ttcgtgctgaataagaagaat

SEQ ID NO: 521 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
tccgagccgttctctacaatt

SEQ ID NO: 522 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine
ccgagccgttctctacaattt

SEQ ID NO: 523 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine
cgagccgttctctacaattat

SEQ ID NO: 524 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
gagccgttctctacaattact

SEQ ID NO: 525 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine
gcctcttcttaacaaatttct

SEQ ID NO: 526 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
ccacagccaaagataagaact

SEQ ID NO: 527 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine
ctactgcagctaaaagacttt

SEQ ID NO: 528 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
tcgtgcgttggctcaatgaat

SEQ ID NO: 529 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
gtgcgttggctcaatgaacat

SEQ ID NO: 530 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
agccttggctcaataccaaat

SEQ ID NO: 531 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine
aactcacctgtaataaattct

SEQ ID NO: 532 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
gacctcaaggtcaccataaat

SEQ ID NO: 533 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine
ctcaaggtcaccataaaacct

SEQ ID NO: 534 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
gatgccaagaacactatgatt

SEQ ID NO: 535 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine
aggatgccactatgtctatat

SEQ ID NO: 536 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
atcaatgttgaccatgaccgtcc

SEQ ID NO: 537 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
attcatagtaggctcggatcttc

SEQ ID NO: 538 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
atttcatagtaggctcggatctt

SEQ ID NO: 539 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agttatagatgtagtagaatttc

SEQ ID NO: 540 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
agtaattgttggagttgcccacg

SEQ ID NO: 541 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aaggtaattgttggagttgccca

SEQ ID NO: 542 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
atcttattcagcacgaacacgcc

SEQ ID NO: 543 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
acttcttattcagcacgaacacg

SEQ ID NO: 544 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
atcttcttattcagcacgaacac

SEQ ID NO: 545 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
attcttcttattcagcacgaaca

SEQ ID NO: 546 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
aagatcttactctgcgtcagttt

SEQ ID NO: 547 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
aattgtagagaacggctcggatt

SEQ ID NO: 548 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aaattgtagagaacggctcggat

SEQ ID NO: 549 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
ataattgtagagaacggctcgga

SEQ ID NO: 550 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
agtaattgtagagaacggctcgg

SEQ ID NO: 551 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aatgtagttggcttcaaggaagt

SEQ ID NO: 552 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
agaaatttgttaagaagaggccc

SEQ ID NO: 553 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agttcttatctttggctgtggtc

SEQ ID NO: 554 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
aaagtcttttagctgcagtaggg

SEQ ID NO: 555 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
attcattgagccaacgcacgacg

SEQ ID NO: 556 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
atgttcattgagccaacgcacga

SEQ ID NO: 557 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
atttggtattgagccaaggcttg

SEQ ID NO: 558 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
agaatttattacaggtgagttga

SEQ ID NO: 559 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
acgaatttattacaggtgagttg

SEQ ID NO: 560 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
atcgaatttattacaggtgagtt

SEQ ID NO: 561 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
atttatggtgaccttgaggtcga

SEQ ID NO: 562 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
agttttatggtgaccttgaggtc

SEQ ID NO: 563 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aggttttatggtgaccttgaggt

SEQ ID NO: 564 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atggttttatggtgaccttgagg

SEQ ID NO: 565 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aatcatagtgttcttggcatcct

SEQ ID NO: 566 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atatagacatagtggcatcctgg

SEQ ID NO: 567 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
atgtaataggcgtagaccttgac

SEQ ID NO: 568 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
attgtaataggcgtagaccttga

SEQ ID NO: 569 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
agttgtaataggcgtagaccttg

SEQ ID NO: 570 - RNA, 23 nt, synthetic construct
  source 1..23: mol_type = other RNA
ggacggtcatggtcaacattgag

SEQ ID NO: 571 - RNA, 23 nt, synthetic construct
  source 1..23: mol_type = other RNA
gaagatccgagcctactatgaaa

SEQ ID NO: 572 - RNA, 23 nt, synthetic construct
  source 1..23: mol_type = other RNA
aagatccgagcctactatgaaaa

SEQ ID NO: 573 - RNA, 23 nt, synthetic construct
  source 1..23: mol_type = other RNA
cgtgggcaactccaacaattacc

SEQ ID NO: 574 - RNA, 23 nt, synthetic construct
  source 1..23: mol_type = other RNA
tgggcaactccaacaattacctg

SEQ ID NO: 575 - RNA, 23 nt, synthetic construct
  source 1..23: mol_type = other RNA
ggcgtgttcgtgctgaataagaa

SEQ ID NO: 576 - RNA, 23 nt, synthetic construct
  source 1..23: mol_type = other RNA
cgtgttcgtgctgaataagaaga

SEQ ID NO: 577 - RNA, 23 nt, synthetic construct
  source 1..23: mol_type = other RNA
gtgttcgtgctgaataagaagaa

SEQ ID NO: 578 - RNA, 23 nt, synthetic construct
  source 1..23: mol_type = other RNA
tgttcgtgctgaataagaagaac

SEQ ID NO: 579 - RNA, 23 nt, synthetic construct
  source 1..23: mol_type = other RNA
aatccgagccgttctctacaatt

SEQ ID NO: 580 - RNA, 23 nt, synthetic construct
  source 1..23: mol_type = other RNA
atccgagccgttctctacaatta

SEQ ID NO: 581 - RNA, 23 nt, synthetic construct
  source 1..23: mol_type = other RNA
tccgagccgttctctacaattac

SEQ ID NO: 582 - RNA, 23 nt, synthetic construct
  source 1..23: mol_type = other RNA
ccgagccgttctctacaattacc

SEQ ID NO: 583 - RNA, 23 nt, synthetic construct
  source 1..23: mol_type = other RNA
gggcctcttcttaacaaatttct

SEQ ID NO: 584 - RNA, 23 nt, synthetic construct
  source 1..23: mol_type = other RNA
gaccacagccaaagataagaacc

SEQ ID NO: 585 - RNA, 23 nt, synthetic construct
  source 1..23: mol_type = other RNA
ccctactgcagctaaaagacttt

SEQ ID NO: 586 - RNA, 23 nt, synthetic construct
  source 1..23: mol_type = other RNA
cgtcgtgcgttggctcaatgaac

SEQ ID NO: 587 - RNA, 23 nt, synthetic construct
  source 1..23: mol_type = other RNA
tcgtgcgttggctcaatgaacag

SEQ ID NO: 588 - RNA, 23 nt, synthetic construct
  source 1..23: mol_type = other RNA
caagccttggctcaataccaaaa

SEQ ID NO: 589 - RNA, 23 nt, synthetic construct
  source 1..23: mol_type = other RNA
tcaactcacctgtaataaattcg

SEQ ID NO: 590 - RNA, 23 nt, synthetic construct
  source 1..23: mol_type = other RNA
tcgacctcaaggtcaccataaaa

SEQ ID NO: 591 - RNA, 23 nt, synthetic construct
  source 1..23: mol_type = other RNA
acctcaaggtcaccataaaacca

SEQ ID NO: 592 - RNA, 23 nt, synthetic construct
  source 1..23: mol_type = other RNA
aggatgccaagaacactatgatc

SEQ ID NO: 593 - RNA, 23 nt, synthetic construct
  source 1..23: mol_type = other RNA
ccaggatgccactatgtctatat

SEQ ID NO: 594 - RNA, 21 nt, synthetic construct
  source 1..21: mol_type = other RNA
acagacaagaccatctacact

SEQ ID NO: 595 - RNA, 21 nt, synthetic construct
  source 1..21: mol_type = other RNA
tgggacattccggaactcgtt

SEQ ID NO: 596 - RNA, 21 nt, synthetic construct
  source 1..21: mol_type = other RNA
gcaggtcttctccactgagtt

SEQ ID NO: 597 - RNA, 21 nt, synthetic construct
  source 1..21: mol_type = other RNA
ccagtttcgaggtcatagtgt

SEQ ID NO: 598 - RNA, 21 nt, synthetic construct
  source 1..21: mol_type = other RNA
actgcctttgtcatcttcggt

SEQ ID NO: 599 - RNA, 21 nt, synthetic construct
  source 1..21: mol_type = other RNA
ctcatggtgttcgtgacgaat

SEQ ID NO: 600 - RNA, 21 nt, synthetic construct
  source 1..21: mol_type = other RNA
gtcaacttcctcctgcgaatt

SEQ ID NO: 601 - RNA, 21 nt, synthetic construct
  source 1..21: mol_type = other RNA
aactgacgcagagtaagatct

SEQ ID NO: 602 - RNA, 21 nt, synthetic construct
  source 1..21: mol_type = other RNA
gaagagaacatcgtttcccgt

SEQ ID NO: 603 - RNA, 21 nt, synthetic construct
  source 1..21: mol_type = other RNA
aagagaacatcgtttcccgat

SEQ ID NO: 604 - RNA, 21 nt, synthetic construct
  source 1..21: mol_type = other RNA
agaacatcgtttcccgaagtt

SEQ ID NO: 605 - RNA, 21 nt, synthetic construct
  source 1..21: mol_type = other RNA
gaacatcgtttcccgaagtgt

SEQ ID NO: 606 - RNA, 21 nt, synthetic construct
  source 1..21: mol_type = other RNA
aacatcgtttcccgaagtgat

SEQ ID NO: 607 - RNA, 21 nt, synthetic construct
  source 1..21: mol_type = other RNA
ggacaagaaagggatctgtgt

SEQ ID NO: 608 - RNA, 21 nt, synthetic construct
  source 1..21: mol_type = other RNA
gacaagaaagggatctgtgtt

SEQ ID NO: 609 - RNA, 21 nt, synthetic construct
  source 1..21: mol_type = other RNA
acaagaaagggatctgtgtgt

SEQ ID NO: 610 - RNA, 21 nt, synthetic construct
  source 1..21: mol_type = other RNA
caagaaagggatctgtgtggt

SEQ ID NO: 611 - RNA, 21 nt, synthetic construct
  source 1..21: mol_type = other RNA
aagaaagggatctgtgtggct

SEQ ID NO: 612 - RNA, 21 nt, synthetic construct
  source 1..21: mol_type = other RNA
gaaagggatctgtgtggcagt

SEQ ID NO: 613 - RNA, 21 nt, synthetic construct
  source 1..21: mol_type = other RNA
cttcgaggtcacagtaatgct

SEQ ID NO: 614 - RNA, 21 nt, synthetic construct
  source 1..21: mol_type = other RNA
ttcgaggtcacagtaatgcat

SEQ ID NO: 615 - RNA, 21 nt, synthetic construct
  source 1..21: mol_type = other RNA
ggctaccctactctgttgttt

SEQ ID NO: 616 - RNA, 21 nt, synthetic construct
  source 1..21: mol_type = other RNA
ctctgttgttcgaaacgagct

SEQ ID NO: 617 - RNA, 21 nt, synthetic construct
  source 1..21: mol_type = other RNA
aacaaaactgtggctgttcgt

SEQ ID NO: 618 - RNA, 21 nt, synthetic construct
  source 1..21: mol_type = other RNA
ggtcatcgctgtgcattacct

SEQ ID NO: 619 - RNA, 21 nt, synthetic construct
  source 1..21: mol_type = other RNA
gtcatcgctgtgcattacctt

SEQ ID NO: 620 - RNA, 21 nt, synthetic construct
  source 1..21: mol_type = other RNA
tgcattacctggatgaaacgt

SEQ ID NO: 621 - RNA, 21 nt, synthetic construct
  source 1..21: mol_type = other RNA
ggcctttgttctcatctcgct

SEQ ID NO: 622 - RNA, 21 nt, synthetic construct
  source 1..21: mol_type = other RNA
gcctttgttctcatctcgctt

SEQ ID NO: 623 - RNA, 21 nt, synthetic construct
  source 1..21: mol_type = other RNA
caatgaacagagatactacgt

SEQ ID NO: 624 - RNA, 21 nt, synthetic construct
  source 1..21: mol_type = other RNA
aatgaacagagatactacggt

SEQ ID NO: 625 - RNA, 21 nt, synthetic construct
  source 1..21: mol_type = other RNA
atgaacagagatactacggtt

SEQ ID NO: 626 - RNA, 21 nt, synthetic construct
  source 1..21: mol_type = other RNA
ccaagccttggctcaatacct

SEQ ID NO: 627 - RNA, 21 nt, synthetic construct
  source 1..21: mol_type = other RNA
caagccttggctcaataccat

SEQ ID NO: 628 - RNA, 21 nt, synthetic construct
  source 1..21: mol_type = other RNA
ccaccgtatccactgggaatt

SEQ ID NO: 629 - RNA, 21 nt, synthetic construct
  source 1..21: mol_type = other RNA
taataaattcgacctcaaggt

SEQ ID NO: 630 - RNA, 21 nt, synthetic construct
  source 1..21: mol_type = other RNA
aggatgccaagaacactatgt

SEQ ID NO: 631 - RNA, 21 nt, synthetic construct
  source 1..21: mol_type = other RNA
aggaacaccctcatcatctat

SEQ ID NO: 632 - RNA, 21 nt, synthetic construct
  source 1..21: mol_type = other RNA
ggaacaccctcatcatctact

SEQ ID NO: 633 - RNA, 21 nt, synthetic construct
  source 1..21: mol_type = other RNA
aacaccctcatcatctacctt

SEQ ID NO: 634 - RNA, 21 nt, synthetic construct
  source 1..21: mol_type = other RNA
ctttaatgtagagcttatcct

SEQ ID NO: 635 - RNA, 21 nt, synthetic construct
  source 1..21: mol_type = other RNA
tttaatgtagagcttatccat

SEQ ID NO: 636 - RNA, 21 nt, synthetic construct
  source 1..21: mol_type = other RNA
tcaaggtctacgcctattact

SEQ ID NO: 637 - RNA, 21 nt, synthetic construct
  source 1..21: mol_type = other RNA
agcatggttgtctttgggtgt

SEQ ID NO: 638 - RNA, 21 nt, synthetic construct
  source 1..21: mol_type = other RNA
aataagaagaacaaactgaca

SEQ ID NO: 639 - RNA, 21 nt, synthetic construct
  source 1..21: mol_type = other RNA
aataagaagaacaagctgaca

SEQ ID NO: 640 - RNA, 23 nt, synthetic construct
  source 1..23: mol_type = other RNA
agtagatggtcttgtctgtctgg

SEQ ID NO: 641 - RNA, 23 nt, synthetic construct
  source 1..23: mol_type = other RNA
agtgtagatggtcttgtctgtct

SEQ ID NO: 642 - RNA, 23 nt, synthetic construct
  source 1..23: mol_type = other RNA
aacgagttccggaatgtcccaag

SEQ ID NO: 643 - RNA, 23 nt, synthetic construct
  source 1..23: mol_type = other RNA
aactcagtggagaagacctgctg

SEQ ID NO: 644 - RNA, 23 nt, synthetic construct
  source 1..23: mol_type = other RNA
acactatgacctcgaaactgggc

SEQ ID NO: 645 - RNA, 23 nt, synthetic construct
  source 1..23: mol_type = other RNA
accgaagatgacaaaggcagttc

SEQ ID NO: 646 - RNA, 23 nt, synthetic construct
  source 1..23: mol_type = other RNA
attcgtcacgaacaccatgaggt

SEQ ID NO: 647 - RNA, 23 nt, synthetic construct
  source 1..23: mol_type = other RNA
aggtaattgttggagttgcccac

SEQ ID NO: 648 - RNA, 23 nt, synthetic construct
  source 1..23: mol_type = other RNA
aattcgcaggaggaagttgacgt

SEQ ID NO: 649 - RNA, 23 nt, synthetic construct
  source 1..23: mol_type = other RNA
agatcttactctgcgtcagtttg

SEQ ID NO: 650 - RNA, 23 nt, synthetic construct
  source 1..23: mol_type = other RNA
acgggaaacgatgttctcttctg

SEQ ID NO: 651 - RNA, 23 nt, synthetic construct
  source 1..23: mol_type = other RNA
atcgggaaacgatgttctcttct

SEQ ID NO: 652 - RNA, 23 nt, synthetic construct
  source 1..23: mol_type = other RNA
aacttcgggaaacgatgttctct

SEQ ID NO: 653 - RNA, 23 nt, synthetic construct
  source 1..23: mol_type = other RNA
acacttcgggaaacgatgttctc

SEQ ID NO: 654 - RNA, 23 nt, synthetic construct
  source 1..23: mol_type = other RNA
atcacttcgggaaacgatgttct

SEQ ID NO: 655 - RNA, 23 nt, synthetic construct
  source 1..23: mol_type = other RNA
aacagatccctttcttgtccgac

SEQ ID NO: 656 - RNA, 23 nt, synthetic construct
  source 1..23: mol_type = other RNA
acacagatccctttcttgtccga

SEQ ID NO: 657 - RNA, 23 nt, synthetic construct
  source 1..23: mol_type = other RNA
aacacagatccctttcttgtccg

SEQ ID NO: 658 - RNA, 23 nt, synthetic construct
  source 1..23: mol_type = other RNA
acacacagatccctttcttgtcc

SEQ ID NO: 659 - RNA, 23 nt, synthetic construct
  source 1..23: mol_type = other RNA
accacacagatccctttcttgtc

SEQ ID NO: 660 - RNA, 23 nt, synthetic construct
  source 1..23: mol_type = other RNA
agccacacagatccctttcttgt

SEQ ID NO: 661 - RNA, 23 nt, synthetic construct
  source 1..23: mol_type = other RNA
actgccacacagatccctttctt

SEQ ID NO: 662 - RNA, 23 nt, synthetic construct
  source 1..23: mol_type = other RNA
agcattactgtgacctcgaaggg

SEQ ID NO: 663 - RNA, 23 nt, synthetic construct
  source 1..23: mol_type = other RNA
atgcattactgtgacctcgaagg

SEQ ID NO: 664 - RNA, 23 nt, synthetic construct
  source 1..23: mol_type = other RNA
aaacaacagagtagggtagccgc

SEQ ID NO: 665 - RNA, 23 nt, synthetic construct
  source 1..23: mol_type = other RNA
atcgtttcgaacaacagagtagg

SEQ ID NO: 666 - RNA, 23 nt, synthetic construct
  source 1..23: mol_type = other RNA
actcgtttcgaacaacagagtag

SEQ ID NO: 667 - RNA, 23 nt, synthetic construct
  source 1..23: mol_type = other RNA
agctcgtttcgaacaacagagta

SEQ ID NO: 668 - RNA, 23 nt, synthetic construct
  source 1..23: mol_type = other RNA
acgaacagccacagttttgttca

SEQ ID NO: 669 - RNA, 23 nt, synthetic construct
  source 1..23: mol_type = other RNA
aggtaatgcacagcgatgaccgt

SEQ ID NO: 670 - RNA, 23 nt, synthetic construct
  source 1..23: mol_type = other RNA
aaggtaatgcacagcgatgaccg

SEQ ID NO: 671 - RNA, 23 nt, synthetic construct
  source 1..23: mol_type = other RNA
acgtttcatccaggtaatgcaca

SEQ ID NO: 672 - RNA, 23 nt, synthetic construct
  source 1..23: mol_type = other RNA
acgagatgagaacaaaggccgtg

SEQ ID NO: 673 - RNA, 23 nt, synthetic construct
  source 1..23: mol_type = other RNA
agcgagatgagaacaaaggccgt

SEQ ID NO: 674 - RNA, 23 nt, synthetic construct
  source 1..23: mol_type = other RNA
aagcgagatgagaacaaaggccg

SEQ ID NO: 675 - RNA, 23 nt, synthetic construct
  source 1..23: mol_type = other RNA
agttcattgagccaacgcacgac

SEQ ID NO: 676 - RNA, 23 nt, synthetic construct
  source 1..23: mol_type = other RNA
acgtagtatctctgttcattgag

SEQ ID NO: 677 - RNA, 23 nt, synthetic construct
  source 1..23: mol_type = other RNA
accgtagtatctctgttcattga

SEQ ID NO: 678 - RNA, 23 nt, synthetic construct
  source 1..23: mol_type = other RNA
aaccgtagtatctctgttcattg

SEQ ID NO: 679 - RNA, 23 nt, synthetic construct
  source 1..23: mol_type = other RNA
aggtattgagccaaggcttggaa

SEQ ID NO: 680 - RNA, 23 nt, synthetic construct
  source 1..23: mol_type = other RNA
atggtattgagccaaggcttgga

SEQ ID NO: 681 - RNA, 23 nt, synthetic construct
  source 1..23: mol_type = other RNA
aattcccagtggatacggtgggt

SEQ ID NO: 682 - RNA, 23 nt, synthetic construct
  source 1..23: mol_type = other RNA
accttgaggtcgaatttattaca

SEQ ID NO: 683 - RNA, 23 nt, synthetic construct
  source 1..23: mol_type = other RNA
attttatggtgaccttgaggtcg

SEQ ID NO: 684 - RNA, 23 nt, synthetic construct
  source 1..23: mol_type = other RNA
acatagtgttcttggcatcctga

SEQ ID NO: 685 - RNA, 23 nt, synthetic construct
  source 1..23: mol_type = other RNA
acatacttggagatgtatctgtc

SEQ ID NO: 686 - RNA, 23 nt, synthetic construct
  source 1..23: mol_type = other RNA
atagatgatgagggtgttcctat

SEQ ID NO: 687 - RNA, 23 nt, synthetic construct
  source 1..23: mol_type = other RNA
agtagatgatgagggtgttccta

SEQ ID NO: 688 - RNA, 23 nt, synthetic construct
  source 1..23: mol_type = other RNA
aaggtagatgatgagggtgttcc

SEQ ID NO: 689 - RNA, 23 nt, synthetic construct
  source 1..23: mol_type = other RNA
aggataagctctacattaaagta

SEQ ID NO: 690 - RNA, 23 nt, synthetic construct
  source 1..23: mol_type = other RNA
atggataagctctacattaaagt

SEQ ID NO: 691 - RNA, 23 nt, synthetic construct
  source 1..23: mol_type = other RNA
agtaataggcgtagaccttgact

SEQ ID NO: 692 - RNA, 23 nt, synthetic construct
  source 1..23: mol_type = other RNA
acaggttgtaataggcgtagacc

SEQ ID NO: 693 - RNA, 23 nt, synthetic construct
  source 1..23: mol_type = other RNA
acacccaaagacaaccatgctct

SEQ ID NO: 694 - RNA, 23 nt, synthetic construct
  source 1..23: mol_type = other RNA
tgtcagtttgttcttcttattca

SEQ ID NO: 695 - RNA, 23 nt, synthetic construct
  source 1..23: mol_type = other RNA
tgtcagcttgttcttcttattca

SEQ ID NO: 696 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
acagacaagaccatctacact

SEQ ID NO: 697 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine
tgggacattccggaactcgtt

SEQ ID NO: 698 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine
gcaggtcttctccactgagtt

SEQ ID NO: 699 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine
ccagtttcgaggtcatagtgt

SEQ ID NO: 700 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine
actgcctttgtcatcttcggt

SEQ ID NO: 701 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine
ctcatggtgttcgtgacgaat

SEQ ID NO: 702 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
gtcaacttcctcctgcgaatt

SEQ ID NO: 703 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine
aactgacgcagagtaagatct

SEQ ID NO: 704 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine
gaagagaacatcgtttcccgt

SEQ ID NO: 705 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
aagagaacatcgtttcccgat

SEQ ID NO: 706 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine
agaacatcgtttcccgaagtt

SEQ ID NO: 707 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine
gaacatcgtttcccgaagtgt

SEQ ID NO: 708 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine
aacatcgtttcccgaagtgat

SEQ ID NO: 709 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine
ggacaagaaagggatctgtgt

SEQ ID NO: 710 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine
gacaagaaagggatctgtgtt

SEQ ID NO: 711 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine
acaagaaagggatctgtgtgt

SEQ ID NO: 712 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine
caagaaagggatctgtgtggt

SEQ ID NO: 713 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine
aagaaagggatctgtgtggct

SEQ ID NO: 714 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine
gaaagggatctgtgtggcagt

SEQ ID NO: 715 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine
cttcgaggtcacagtaatgct

SEQ ID NO: 716 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
ttcgaggtcacagtaatgcat

SEQ ID NO: 717 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine
ggctaccctactctgttgttt

SEQ ID NO: 718 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine
ctctgttgttcgaaacgagct

SEQ ID NO: 719 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine
aacaaaactgtggctgttcgt

SEQ ID NO: 720 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine
ggtcatcgctgtgcattacct

SEQ ID NO: 721 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
gtcatcgctgtgcattacctt

SEQ ID NO: 722 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine
tgcattacctggatgaaacgt

SEQ ID NO: 723 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine
ggcctttgttctcatctcgct

SEQ ID NO: 724 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
gcctttgttctcatctcgctt

SEQ ID NO: 725 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine
caatgaacagagatactacgt

SEQ ID NO: 726 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine
aatgaacagagatactacggt

SEQ ID NO: 727 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine
atgaacagagatactacggtt

SEQ ID NO: 728 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine
ccaagccttggctcaatacct

SEQ ID NO: 729 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
caagccttggctcaataccat

SEQ ID NO: 730 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine
ccaccgtatccactgggaatt

SEQ ID NO: 731 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine
taataaattcgacctcaaggt

SEQ ID NO: 732 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine
aggatgccaagaacactatgt

SEQ ID NO: 733 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine
aggaacaccctcatcatctat

SEQ ID NO: 734 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
ggaacaccctcatcatctact

SEQ ID NO: 735 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine
aacaccctcatcatctacctt

SEQ ID NO: 736 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine
ctttaatgtagagcttatcct

SEQ ID NO: 737 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine
tttaatgtagagcttatccat

SEQ ID NO: 738 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine
tcaaggtctacgcctattact

SEQ ID NO: 739 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine
agcatggttgtctttgggtgt

SEQ ID NO: 740 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine
aataagaagaacaaactgaca

SEQ ID NO: 741 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine
aataagaagaacaagctgaca

SEQ ID NO: 742 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
agtagatggtcttgtctgtctgg

SEQ ID NO: 743 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
agtgtagatggtcttgtctgtct

SEQ ID NO: 744 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
aacgagttccggaatgtcccaag

SEQ ID NO: 745 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aatgttgacgagttccggaatgt

SEQ ID NO: 746 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aactcagtggagaagacctgctg

SEQ ID NO: 747 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
actatgacctcgaaactgggcag

SEQ ID NO: 748 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
acactatgacctcgaaactgggc

SEQ ID NO: 749 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
accgaagatgacaaaggcagttc

SEQ ID NO: 750 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
attcgtcacgaacaccatgaggt

SEQ ID NO: 751 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
aggtaattgttggagttgcccac

SEQ ID NO: 752 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
acaggtaattgttggagttgccc

SEQ ID NO: 753 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aattcgcaggaggaagttgacgt

SEQ ID NO: 754 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
agatcttactctgcgtcagtttg

SEQ ID NO: 755 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
aaaacgatgttctcttctgcaat

SEQ ID NO: 756 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
acgggaaacgatgttctcttctg

SEQ ID NO: 757 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
atcgggaaacgatgttctcttct

SEQ ID NO: 758 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aacttcgggaaacgatgttctct

SEQ ID NO: 759 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
acacttcgggaaacgatgttctc

SEQ ID NO: 760 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
atcacttcgggaaacgatgttct

SEQ ID NO: 761 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
aacagatccctttcttgtccgac

SEQ ID NO: 762 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acacagatccctttcttgtccga

SEQ ID NO: 763 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
aacacagatccctttcttgtccg

SEQ ID NO: 764 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
acacacagatccctttcttgtcc

SEQ ID NO: 765 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
accacacagatccctttcttgtc

SEQ ID NO: 766 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agccacacagatccctttcttgt

SEQ ID NO: 767 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
actgccacacagatccctttctt

SEQ ID NO: 768 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
agcattactgtgacctcgaaggg

SEQ ID NO: 769 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atgcattactgtgacctcgaagg

SEQ ID NO: 770 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aaacaacagagtagggtagccgc

SEQ ID NO: 771 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
acgaacaacagagtagggtagcc

SEQ ID NO: 772 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
atcgaacaacagagtagggtagc

SEQ ID NO: 773 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
attcgaacaacagagtagggtag

SEQ ID NO: 774 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
atttcgaacaacagagtagggta

SEQ ID NO: 775 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agtttcgaacaacagagtagggt

SEQ ID NO: 776 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
acgtttcgaacaacagagtaggg

SEQ ID NO: 777 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
atcgtttcgaacaacagagtagg

SEQ ID NO: 778 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
actcgtttcgaacaacagagtag

SEQ ID NO: 779 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
agctcgtttcgaacaacagagta

SEQ ID NO: 780 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
accggtaattgtagagaacggct

SEQ ID NO: 781 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
acgaacagccacagttttgttca

SEQ ID NO: 782 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aggtaatgcacagcgatgaccgt

SEQ ID NO: 783 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
aaggtaatgcacagcgatgaccg

SEQ ID NO: 784 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
acgtttcatccaggtaatgcaca

SEQ ID NO: 785 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
agagagaagaccttgaccacgta

SEQ ID NO: 786 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
acgagatgagaacaaaggccgtg

SEQ ID NO: 787 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agcgagatgagaacaaaggccgt

SEQ ID NO: 788 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
aagcgagatgagaacaaaggccg

SEQ ID NO: 789 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
agtcaaagtcttttagctgcagt

SEQ ID NO: 790 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
agttcattgagccaacgcacgac

SEQ ID NO: 791 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
acgtagtatctctgttcattgag

SEQ ID NO: 792 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
accgtagtatctctgttcattga

SEQ ID NO: 793 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaccgtagtatctctgttcattg

SEQ ID NO: 794 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
aggtattgagccaaggcttggaa

SEQ ID NO: 795 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
atggtattgagccaaggcttgga

SEQ ID NO: 796 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
aattcccagtggatacggtgggt

SEQ ID NO: 797 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
aaaaccctcattttccttggtct

SEQ ID NO: 798 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
agtgaaaccctcattttccttgg

SEQ ID NO: 799 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
aaggtcgaatttattacaggtga

SEQ ID NO: 800 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
accttgaggtcgaatttattaca

SEQ ID NO: 801 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
attttatggtgaccttgaggtcg

SEQ ID NO: 802 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
acatagtgttcttggcatcctga

SEQ ID NO: 803 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
acatacttggagatgtatctgtc

SEQ ID NO: 804 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
aatcggagaaggctttgtccagc

SEQ ID NO: 805 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
atagatgatgagggtgttcctat

SEQ ID NO: 806 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyladenosine
agtagatgatgagggtgttccta

SEQ ID NO: 807 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
aaggtagatgatgagggtgttcc

SEQ ID NO: 808 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
aggataagctctacattaaagta

SEQ ID NO: 809 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
atggataagctctacattaaagt

SEQ ID NO: 810 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
agtaataggcgtagaccttgact

SEQ ID NO: 811 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
acaggttgtaataggcgtagacc

SEQ ID NO: 812 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
agtcaaagtcattggacagctga

SEQ ID NO: 813 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
acgtcaaagtcattggacagctg

SEQ ID NO: 814 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
acacccaaagacaaccatgctct

SEQ ID NO: 815 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tgtcagtttgttcttcttattca

SEQ ID NO: 816 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tgtcagcttgttcttcttattca

SEQ ID NO: 817 - RNA, 23 nt, synthetic construct
  source 1..23: mol_type = other RNA
agacagacaagaccatctacacc

SEQ ID NO: 818 - RNA, 23 nt, synthetic construct
  source 1..23: mol_type = other RNA
cttgggacattccggaactcgtc

SEQ ID NO: 819 - RNA, 23 nt, synthetic construct
  source 1..23: mol_type = other RNA
cagcaggtcttctccactgagtt

SEQ ID NO: 820 - RNA, 23 nt, synthetic construct
  source 1..23: mol_type = other RNA
gcccagtttcgaggtcatagtgg

SEQ ID NO: 821 - RNA, 23 nt, synthetic construct
  source 1..23: mol_type = other RNA
gaactgcctttgtcatcttcggg

SEQ ID NO: 822 - RNA, 23 nt, synthetic construct
  source 1..23: mol_type = other RNA
acctcatggtgttcgtgacgaac

SEQ ID NO: 823 - RNA, 23 nt, synthetic construct
  source 1..23: mol_type = other RNA
acgtcaacttcctcctgcgaatg

SEQ ID NO: 824 - RNA, 23 nt, synthetic construct
  source 1..23: mol_type = other RNA
caaactgacgcagagtaagatct

SEQ ID NO: 825 - RNA, 23 nt, synthetic construct
  source 1..23: mol_type = other RNA
cagaagagaacatcgtttcccga

SEQ ID NO: 826 - RNA, 23 nt, synthetic construct
  source 1..23: mol_type = other RNA
agaagagaacatcgtttcccgaa

SEQ ID NO: 827 - RNA, 23 nt, synthetic construct
  source 1..23: mol_type = other RNA
agagaacatcgtttcccgaagtg

SEQ ID NO: 828 - RNA, 23 nt, synthetic construct
  source 1..23: mol_type = other RNA
gagaacatcgtttcccgaagtga

SEQ ID NO: 829 - RNA, 23 nt, synthetic construct
  source 1..23: mol_type = other RNA
agaacatcgtttcccgaagtgag

SEQ ID NO: 830 - RNA, 23 nt, synthetic construct
  source 1..23: mol_type = other RNA
tcggacaagaaagggatctgtgt

SEQ ID NO: 831 - RNA, 23 nt, synthetic construct
  source 1..23: mol_type = other RNA
cggacaagaaagggatctgtgtg

SEQ ID NO: 832 - RNA, 23 nt, synthetic construct
  source 1..23: mol_type = other RNA
ggacaagaaagggatctgtgtgg

SEQ ID NO: 833 - RNA, 23 nt, synthetic construct
  source 1..23: mol_type = other RNA
gacaagaaagggatctgtgtggc

SEQ ID NO: 834 - RNA, 23 nt, synthetic construct
  source 1..23: mol_type = other RNA
acaagaaagggatctgtgtggca

SEQ ID NO: 835 - RNA, 23 nt, synthetic construct
  source 1..23: mol_type = other RNA
aagaaagggatctgtgtggcaga

SEQ ID NO: 836 - RNA, 23 nt, synthetic construct
  source 1..23: mol_type = other RNA
cccttcgaggtcacagtaatgca

SEQ ID NO: 837 - RNA, 23 nt, synthetic construct
  source 1..23: mol_type = other RNA
ccttcgaggtcacagtaatgcag

SEQ ID NO: 838 - RNA, 23 nt, synthetic construct
  source 1..23: mol_type = other RNA
gcggctaccctactctgttgttc

SEQ ID NO: 839 - RNA, 23 nt, synthetic construct
  source 1..23: mol_type = other RNA
tactctgttgttcgaaacgagca

SEQ ID NO: 840 - RNA, 23 nt, synthetic construct
  source 1..23: mol_type = other RNA
tgaacaaaactgtggctgttcgc

SEQ ID NO: 841 - RNA, 23 nt, synthetic construct
  source 1..23: mol_type = other RNA
acggtcatcgctgtgcattacct

SEQ ID NO: 842 - RNA, 23 nt, synthetic construct
  source 1..23: mol_type = other RNA
cggtcatcgctgtgcattacctg

SEQ ID NO: 843 - RNA, 23 nt, synthetic construct
  source 1..23: mol_type = other RNA
tgtgcattacctggatgaaacgg

SEQ ID NO: 844 - RNA, 23 nt, synthetic construct
  source 1..23: mol_type = other RNA
acggcctttgttctcatctcgct

SEQ ID NO: 845 - RNA, 23 nt, synthetic construct
  source 1..23: mol_type = other RNA
cggcctttgttctcatctcgctg

SEQ ID NO: 846 - RNA, 23 nt, synthetic construct
  source 1..23: mol_type = other RNA
ctcaatgaacagagatactacgg

SEQ ID NO: 847 - RNA, 23 nt, synthetic construct
  source 1..23: mol_type = other RNA
tcaatgaacagagatactacggt

SEQ ID NO: 848 - RNA, 23 nt, synthetic construct
  source 1..23: mol_type = other RNA
caatgaacagagatactacggtg

SEQ ID NO: 849 - RNA, 23 nt, synthetic construct
  source 1..23: mol_type = other RNA
ttccaagccttggctcaatacca

SEQ ID NO: 850 - RNA, 23 nt, synthetic construct
  source 1..23: mol_type = other RNA
tccaagccttggctcaataccaa

SEQ ID NO: 851 - RNA, 23 nt, synthetic construct
  source 1..23: mol_type = other RNA
acccaccgtatccactgggaatc

SEQ ID NO: 852 - RNA, 23 nt, synthetic construct
  source 1..23: mol_type = other RNA
tgtaataaattcgacctcaaggt

SEQ ID NO: 853 - RNA, 23 nt, synthetic construct
  source 1..23: mol_type = other RNA
tcaggatgccaagaacactatga

SEQ ID NO: 854 - RNA, 23 nt, synthetic construct
  source 1..23: mol_type = other RNA
ataggaacaccctcatcatctac

SEQ ID NO: 855 - RNA, 23 nt, synthetic construct
  source 1..23: mol_type = other RNA
taggaacaccctcatcatctacc

SEQ ID NO: 856 - RNA, 23 nt, synthetic construct
  source 1..23: mol_type = other RNA
ggaacaccctcatcatctacctg

SEQ ID NO: 857 - RNA, 23 nt, synthetic construct
  source 1..23: mol_type = other RNA
tactttaatgtagagcttatcca

SEQ ID NO: 858 - RNA, 23 nt, synthetic construct
  source 1..23: mol_type = other RNA
actttaatgtagagcttatccag

SEQ ID NO: 859 - RNA, 23 nt, synthetic construct
  source 1..23: mol_type = other RNA
agtcaaggtctacgcctattaca

SEQ ID NO: 860 - RNA, 23 nt, synthetic construct
  source 1..23: mol_type = other RNA
agagcatggttgtctttgggtgc

SEQ ID NO: 861 - RNA, 21 nt, synthetic construct
  source 1..21: mol_type = other RNA
aataagaagaacaaactgaca

SEQ ID NO: 862 - RNA, 21 nt, synthetic construct
  source 1..21: mol_type = other RNA
aataagaagaacaagctgaca

SEQ ID NO: 863 - RNA, 21 nt, synthetic construct
  source 1..21: mol_type = other RNA
aacaccctcatcatctacctt

SEQ ID NO: 864 - RNA, 21 nt, synthetic construct
  source 1..21: mol_type = other RNA
gtggtcaaggtcttctctcta

SEQ ID NO: 865 - RNA, 21 nt, synthetic construct
  source 1..21: mol_type = other RNA
tacctcttcatccagacagaa

SEQ ID NO: 866 - RNA, 21 nt, synthetic construct
  source 1..21: mol_type = other RNA
ccagatccacttcaccaagaa

SEQ ID NO: 867 - RNA, 21 nt, synthetic construct
  source 1..21: mol_type = other RNA
cgggtacctcttcatccagaa

SEQ ID NO: 868 - RNA, 21 nt, synthetic construct
  source 1..21: mol_type = other RNA
gtacctcttcatccagacaga

SEQ ID NO: 869 - RNA, 21 nt, synthetic construct
  source 1..21: mol_type = other RNA
catccagacagacaagaccaa

SEQ ID NO: 870 - RNA, 21 nt, synthetic construct
  source 1..21: mol_type = other RNA
ccagacagacaagaccatcta

SEQ ID NO: 871 - RNA, 21 nt, synthetic construct
  source 1..21: mol_type = other RNA
agacagacaagaccatctaca

SEQ ID NO: 872 - RNA, 21 nt, synthetic construct
  source 1..21: mol_type = other RNA
acagacaagaccatctacaca

SEQ ID NO: 873 - RNA, 21 nt, synthetic construct
  source 1..21: mol_type = other RNA
gacagacaagaccatctacaa

SEQ ID NO: 874 - RNA, 21 nt, synthetic construct
  source 1..21: mol_type = other RNA
acggtcatggtcaacattgaa

SEQ ID NO: 875 - RNA, 21 nt, synthetic construct
  source 1..21: mol_type = other RNA
tgggacattccggaactcgta

SEQ ID NO: 876 - RNA, 21 nt, synthetic construct
  source 1..21: mol_type = other RNA
attccggaactcgtcaacata

SEQ ID NO: 877 - RNA, 21 nt, synthetic construct
  source 1..21: mol_type = other RNA
agatccgagcctactatgaaa

SEQ ID NO: 878 - RNA, 21 nt, synthetic construct
  source 1..21: mol_type = other RNA
gatccgagcctactatgaaaa

SEQ ID NO: 879 - RNA, 21 nt, synthetic construct
  source 1..21: mol_type = other RNA
gcaggtcttctccactgagta

SEQ ID NO: 880 - RNA, 21 nt, synthetic construct
  source 1..21: mol_type = other RNA
cactgagtttgaggtgaagga

SEQ ID NO: 881 - RNA, 21 nt, synthetic construct
  source 1..21: mol_type = other RNA
actgagtttgaggtgaaggaa

SEQ ID NO: 882 - RNA, 21 nt, synthetic construct
  source 1..21: mol_type = other RNA
gcccagtttcgaggtcataga

SEQ ID NO: 883 - RNA, 21 nt, synthetic construct
  source 1..21: mol_type = other RNA
ccagtttcgaggtcatagtga

SEQ ID NO: 884 - RNA, 21 nt, synthetic construct
  source 1..21: mol_type = other RNA
aattctactacatctataaca

SEQ ID NO: 885 - RNA, 21 nt, synthetic construct
  source 1..21: mol_type = other RNA
actgcctttgtcatcttcgga

SEQ ID NO: 886 - RNA, 21 nt, synthetic construct
  source 1..21: mol_type = other RNA
tccctaccagatccacttcaa

SEQ ID NO: 887 - RNA, 21 nt, synthetic construct
  source 1..21: mol_type = other RNA
ccctaccagatccacttcaca

SEQ ID NO: 888 - RNA, 21 nt, synthetic construct
  source 1..21: mol_type = other RNA
ctaccagatccacttcaccaa

SEQ ID NO: 889 - RNA, 21 nt, synthetic construct
  source 1..21: mol_type = other RNA
taccagatccacttcaccaaa

SEQ ID NO: 890 - RNA, 21 nt, synthetic construct
  source 1..21: mol_type = other RNA
ctcatggtgttcgtgacgaaa

SEQ ID NO: 891 - RNA, 21 nt, synthetic construct
  source 1..21: mol_type = other RNA
tgggcaactccaacaattaca

SEQ ID NO: 892 - RNA, 21 nt, synthetic construct
  source 1..21: mol_type = other RNA
gggcaactccaacaattacca

SEQ ID NO: 893 - RNA, 21 nt, synthetic construct
  source 1..21: mol_type = other RNA
ggcaactccaacaattaccta

SEQ ID NO: 894 - RNA, 21 nt, synthetic construct
  source 1..21: mol_type = other RNA
gcaactccaacaattacctga

SEQ ID NO: 895 - RNA, 21 nt, synthetic construct
  source 1..21: mol_type = other RNA
caactccaacaattacctgca

SEQ ID NO: 896 - RNA, 21 nt, synthetic construct
  source 1..21: mol_type = other RNA
caacaattacctgcatctcta

SEQ ID NO: 897 - RNA, 21 nt, synthetic construct
  source 1..21: mol_type = other RNA
gtcaacttcctcctgcgaata

SEQ ID NO: 898 - RNA, 21 nt, synthetic construct
  source 1..21: mol_type = other RNA
caagatccgctactacaccta

SEQ ID NO: 899 - RNA, 21 nt, synthetic construct
  source 1..21: mol_type = other RNA
cgtgttcgtgctgaataagaa

SEQ ID NO: 900 - RNA, 21 nt, synthetic construct
  source 1..21: mol_type = other RNA
tgttcgtgctgaataagaaga

SEQ ID NO: 901 - RNA, 21 nt, synthetic construct
  source 1..21: mol_type = other RNA
gttcgtgctgaataagaagaa

SEQ ID NO: 902 - RNA, 21 nt, synthetic construct
  source 1..21: mol_type = other RNA
ttcgtgctgaataagaagaaa

SEQ ID NO: 903 - RNA, 21 nt, synthetic construct
  source 1..21: mol_type = other RNA
cgtgctgaataagaagaacaa

SEQ ID NO: 904 - RNA, 21 nt, synthetic construct
  source 1..21: mol_type = other RNA
gtgctgaataagaagaacaaa

SEQ ID NO: 905 - RNA, 21 nt, synthetic construct
  source 1..21: mol_type = other RNA
aactgacgcagagtaagatca

SEQ ID NO: 906 - RNA, 21 nt, synthetic construct
  source 1..21: mol_type = other RNA
actgacgcagagtaagatcta

SEQ ID NO: 907 - RNA, 21 nt, synthetic construct
  source 1..21: mol_type = other RNA
tgcagaagagaacatcgttta

SEQ ID NO: 908 - RNA, 21 nt, synthetic construct
  source 1..21: mol_type = other RNA
gaagagaacatcgtttcccga

SEQ ID NO: 909 - RNA, 21 nt, synthetic construct
  source 1..21: mol_type = other RNA
aagagaacatcgtttcccgaa

SEQ ID NO: 910 - RNA, 21 nt, synthetic construct
  source 1..21: mol_type = other RNA
agaacatcgtttcccgaagta

SEQ ID NO: 911 - RNA, 21 nt, synthetic construct
  source 1..21: mol_type = other RNA
gaacatcgtttcccgaagtga

SEQ ID NO: 912 - RNA, 21 nt, synthetic construct
  source 1..21: mol_type = other RNA
aacatcgtttcccgaagtgaa

SEQ ID NO: 913 - RNA, 21 nt, synthetic construct
  source 1..21: mol_type = other RNA
catgtcggacaagaaagggaa

SEQ ID NO: 914 - RNA, 21 nt, synthetic construct
  source 1..21: mol_type = other RNA
atgtcggacaagaaagggata

SEQ ID NO: 915 - RNA, 21 nt, synthetic construct
  source 1..21: mol_type = other RNA
gtcggacaagaaagggatcta

SEQ ID NO: 916 - RNA, 21 nt, synthetic construct
  source 1..21: mol_type = other RNA
cggacaagaaagggatctgta

SEQ ID NO: 917 - RNA, 21 nt, synthetic construct
  source 1..21: mol_type = other RNA
ggacaagaaagggatctgtga

SEQ ID NO: 918 - RNA, 21 nt, synthetic construct
  source 1..21: mol_type = other RNA
gacaagaaagggatctgtgta

SEQ ID NO: 919 - RNA, 21 nt, synthetic construct
  source 1..21: mol_type = other RNA
acaagaaagggatctgtgtga

SEQ ID NO: 920 - RNA, 21 nt, synthetic construct
  source 1..21: mol_type = other RNA
caagaaagggatctgtgtgga

SEQ ID NO: 921 - RNA, 21 nt, synthetic construct
  source 1..21: mol_type = other RNA
aagaaagggatctgtgtggca

SEQ ID NO: 922 - RNA, 21 nt, synthetic construct
  source 1..21: mol_type = other RNA
gaaagggatctgtgtggcaga

SEQ ID NO: 923 - RNA, 21 nt, synthetic construct
  source 1..21: mol_type = other RNA
cttcgaggtcacagtaatgca

SEQ ID NO: 924 - RNA, 21 nt, synthetic construct
  source 1..21: mol_type = other RNA
ttcgaggtcacagtaatgcaa

SEQ ID NO: 925 - RNA, 21 nt, synthetic construct
  source 1..21: mol_type = other RNA
acagtaatgcaggacttctta

SEQ ID NO: 926 - RNA, 21 nt, synthetic construct
  source 1..21: mol_type = other RNA
agtaatgcaggacttcttcaa

SEQ ID NO: 927 - RNA, 21 nt, synthetic construct
  source 1..21: mol_type = other RNA
gtaatgcaggacttcttcata

SEQ ID NO: 928 - RNA, 21 nt, synthetic construct
  source 1..21: mol_type = other RNA
ggctaccctactctgttgtta

SEQ ID NO: 929 - RNA, 21 nt, synthetic construct
  source 1..21: mol_type = other RNA
ctaccctactctgttgttcga

SEQ ID NO: 930 - RNA, 21 nt, synthetic construct
  source 1..21: mol_type = other RNA
taccctactctgttgttcgaa

SEQ ID NO: 931 - RNA, 21 nt, synthetic construct
  source 1..21: mol_type = other RNA
accctactctgttgttcgaaa

SEQ ID NO: 932 - RNA, 21 nt, synthetic construct
  source 1..21: mol_type = other RNA
ccctactctgttgttcgaaaa

SEQ ID NO: 933 - RNA, 21 nt, synthetic construct
  source 1..21: mol_type = other RNA
cctactctgttgttcgaaaca

SEQ ID NO: 934 - RNA, 21 nt, synthetic construct
  source 1..21: mol_type = other RNA
ctactctgttgttcgaaacga

SEQ ID NO: 935 - RNA, 21 nt, synthetic construct
  source 1..21: mol_type = other RNA
tactctgttgttcgaaacgaa

SEQ ID NO: 936 - RNA, 21 nt, synthetic construct
  source 1..21: mol_type = other RNA
actctgttgttcgaaacgaga

SEQ ID NO: 937 - RNA, 21 nt, synthetic construct
  source 1..21: mol_type = other RNA
ctctgttgttcgaaacgagca

SEQ ID NO: 938 - RNA, 21 nt, synthetic construct
  source 1..21: mol_type = other RNA
tccgagccgttctctacaata

SEQ ID NO: 939 - RNA, 21 nt, synthetic construct
  source 1..21: mol_type = other RNA
ccgagccgttctctacaatta

SEQ ID NO: 940 - RNA, 21 nt, synthetic construct
  source 1..21: mol_type = other RNA
cgagccgttctctacaattaa

SEQ ID NO: 941 - RNA, 21 nt, synthetic construct
  source 1..21: mol_type = other RNA
gagccgttctctacaattaca

SEQ ID NO: 942 - RNA, 21 nt, synthetic construct
  source 1..21: mol_type = other RNA
ccgttctctacaattaccgga

SEQ ID NO: 943 - RNA, 21 nt, synthetic construct
  source 1..21: mol_type = other RNA
ggtggaactactccacaatca

SEQ ID NO: 944 - RNA, 21 nt, synthetic construct
  source 1..21: mol_type = other RNA
aacaaaactgtggctgttcga

SEQ ID NO: 945 - RNA, 21 nt, synthetic construct
  source 1..21: mol_type = other RNA
ccgagtctgagaccagaatta

SEQ ID NO: 946 - RNA, 21 nt, synthetic construct
  source 1..21: mol_type = other RNA
ggtcatcgctgtgcattacca

SEQ ID NO: 947 - RNA, 21 nt, synthetic construct
  source 1..21: mol_type = other RNA
gtcatcgctgtgcattaccta

SEQ ID NO: 948 - RNA, 21 nt, synthetic construct
  source 1..21: mol_type = other RNA
gtgcattacctggatgaaaca

SEQ ID NO: 949 - RNA, 21 nt, synthetic construct
  source 1..21: mol_type = other RNA
tgcattacctggatgaaacga

SEQ ID NO: 950 - RNA, 21 nt, synthetic construct
  source 1..21: mol_type = other RNA
ctacgtggtcaaggtcttcta

SEQ ID NO: 951 - RNA, 21 nt, synthetic construct
  source 1..21: mol_type = other RNA
cgtggtcaaggtcttctctca

SEQ ID NO: 952 - RNA, 21 nt, synthetic construct
  source 1..21: mol_type = other RNA
cgtgatacaccaagaaatgaa

SEQ ID NO: 953 - RNA, 21 nt, synthetic construct
  source 1..21: mol_type = other RNA
cggcctttgttctcatctcga

SEQ ID NO: 954 - RNA, 21 nt, synthetic construct
  source 1..21: mol_type = other RNA
ggcctttgttctcatctcgca

SEQ ID NO: 955 - RNA, 21 nt, synthetic construct
  source 1..21: mol_type = other RNA
gcctttgttctcatctcgcta

SEQ ID NO: 956 - RNA, 21 nt, synthetic construct
  source 1..21: mol_type = other RNA
gacttccttgaagccaactaa

SEQ ID NO: 957 - RNA, 21 nt, synthetic construct
  source 1..21: mol_type = other RNA
ttccttgaagccaactacata

SEQ ID NO: 958 - RNA, 21 nt, synthetic construct
  source 1..21: mol_type = other RNA
aagccaactacatgaacctaa

SEQ ID NO: 959 - RNA, 21 nt, synthetic construct
  source 1..21: mol_type = other RNA
agccaactacatgaacctaca

SEQ ID NO: 960 - RNA, 21 nt, synthetic construct
  source 1..21: mol_type = other RNA
caactacatgaacctacagaa

SEQ ID NO: 961 - RNA, 21 nt, synthetic construct
  source 1..21: mol_type = other RNA
gcctcttcttaacaaatttca

SEQ ID NO: 962 - RNA, 21 nt, synthetic construct
  source 1..21: mol_type = other RNA
ttctgaccacagccaaagata

SEQ ID NO: 963 - RNA, 21 nt, synthetic construct
  source 1..21: mol_type = other RNA
ccacagccaaagataagaaca

SEQ ID NO: 964 - RNA, 21 nt, synthetic construct
  source 1..21: mol_type = other RNA
ctactgcagctaaaagactta

SEQ ID NO: 965 - RNA, 21 nt, synthetic construct
  source 1..21: mol_type = other RNA
tgcagctaaaagactttgaca

SEQ ID NO: 966 - RNA, 21 nt, synthetic construct
  source 1..21: mol_type = other RNA
tcgtgcgttggctcaatgaaa

SEQ ID NO: 967 - RNA, 21 nt, synthetic construct
  source 1..21: mol_type = other RNA
cgtgcgttggctcaatgaaca

SEQ ID NO: 968 - RNA, 21 nt, synthetic construct
  source 1..21: mol_type = other RNA
gtgcgttggctcaatgaacaa

SEQ ID NO: 969 - RNA, 21 nt, synthetic construct
  source 1..21: mol_type = other RNA
caatgaacagagatactacga

SEQ ID NO: 970 - RNA, 21 nt, synthetic construct
  source 1..21: mol_type = other RNA
aatgaacagagatactacgga

SEQ ID NO: 971 - RNA, 21 nt, synthetic construct
  source 1..21: mol_type = other RNA
atgaacagagatactacggta

SEQ ID NO: 972 - RNA, 21 nt, synthetic construct
  source 1..21: mol_type = other RNA
ttcatggtgttccaagcctta

SEQ ID NO: 973 - RNA, 21 nt, synthetic construct
  source 1..21: mol_type = other RNA
ccaagccttggctcaatacca

SEQ ID NO: 974 - RNA, 21 nt, synthetic construct
  source 1..21: mol_type = other RNA
caagccttggctcaataccaa

SEQ ID NO: 975 - RNA, 21 nt, synthetic construct
  source 1..21: mol_type = other RNA
agccttggctcaataccaaaa

SEQ ID NO: 976 - RNA, 21 nt, synthetic construct
  source 1..21: mol_type = other RNA
ccaccgtatccactgggaata

SEQ ID NO: 977 - RNA, 21 nt, synthetic construct
  source 1..21: mol_type = other RNA
ctgcgatcagaagagaccaaa

SEQ ID NO: 978 - RNA, 21 nt, synthetic construct
  source 1..21: mol_type = other RNA
tgcgatcagaagagaccaaga

SEQ ID NO: 979 - RNA, 21 nt, synthetic construct
  source 1..21: mol_type = other RNA
ccaaggaaaatgagggtttca

SEQ ID NO: 980 - RNA, 21 nt, synthetic construct
  source 1..21: mol_type = other RNA
aaggaaaatgagggtttcaca

SEQ ID NO: 981 - RNA, 21 nt, synthetic construct
  source 1..21: mol_type = other RNA
aactcacctgtaataaattca

SEQ ID NO: 982 - RNA, 21 nt, synthetic construct
  source 1..21: mol_type = other RNA
actcacctgtaataaattcga

SEQ ID NO: 983 - RNA, 21 nt, synthetic construct
  source 1..21: mol_type = other RNA
ctcacctgtaataaattcgaa

SEQ ID NO: 984 - RNA, 21 nt, synthetic construct
  source 1..21: mol_type = other RNA
acctgtaataaattcgaccta

SEQ ID NO: 985 - RNA, 21 nt, synthetic construct
  source 1..21: mol_type = other RNA
cctgtaataaattcgacctca

SEQ ID NO: 986 - RNA, 21 nt, synthetic construct
  source 1..21: mol_type = other RNA
ctgtaataaattcgacctcaa

SEQ ID NO: 987 - RNA, 21 nt, synthetic construct
  source 1..21: mol_type = other RNA
taataaattcgacctcaagga

SEQ ID NO: 988 - RNA, 21 nt, synthetic construct
  source 1..21: mol_type = other RNA
gacctcaaggtcaccataaaa

SEQ ID NO: 989 - RNA, 21 nt, synthetic construct
  source 1..21: mol_type = other RNA
acctcaaggtcaccataaaaa

SEQ ID NO: 990 - RNA, 21 nt, synthetic construct
  source 1..21: mol_type = other RNA
cctcaaggtcaccataaaaca

SEQ ID NO: 991 - RNA, 21 nt, synthetic construct
  source 1..21: mol_type = other RNA
ctcaaggtcaccataaaacca

SEQ ID NO: 992 - RNA, 21 nt, synthetic construct
  source 1..21: mol_type = other RNA
tcaaggtcaccataaaaccaa

SEQ ID NO: 993 - RNA, 21 nt, synthetic construct
  source 1..21: mol_type = other RNA
aggatgccaagaacactatga

SEQ ID NO: 994 - RNA, 21 nt, synthetic construct
  source 1..21: mol_type = other RNA
gatgccaagaacactatgata

SEQ ID NO: 995 - RNA, 21 nt, synthetic construct
  source 1..21: mol_type = other RNA
aggatgccactatgtctataa

SEQ ID NO: 996 - RNA, 21 nt, synthetic construct
  source 1..21: mol_type = other RNA
cagatacatctccaagtatga

SEQ ID NO: 997 - RNA, 21 nt, synthetic construct
  source 1..21: mol_type = other RNA
tggacaaagccttctccgata

SEQ ID NO: 998 - RNA, 21 nt, synthetic construct
  source 1..21: mol_type = other RNA
aggaacaccctcatcatctaa

SEQ ID NO: 999 - RNA, 21 nt, synthetic construct
  source 1..21: mol_type = other RNA
ggaacaccctcatcatctaca

SEQ ID NO: 1000 - RNA, 21 nt, synthetic construct
  source 1..21: mol_type = other RNA
aacaccctcatcatctaccta

SEQ ID NO: 1001 - RNA, 21 nt, synthetic construct
  source 1..21: mol_type = other RNA
tctagctttcaaagttcacca

SEQ ID NO: 1002 - RNA, 21 nt, synthetic construct
  source 1..21: mol_type = other RNA
ctagctttcaaagttcaccaa

SEQ ID NO: 1003 - RNA, 21 nt, synthetic construct
  source 1..21: mol_type = other RNA
ctttaatgtagagcttatcca

SEQ ID NO: 1004 - RNA, 21 nt, synthetic construct
  source 1..21: mol_type = other RNA
tttaatgtagagcttatccaa

SEQ ID NO: 1005 - RNA, 21 nt, synthetic construct
  source 1..21: mol_type = other RNA
agtcaaggtctacgcctatta

SEQ ID NO: 1006 - RNA, 21 nt, synthetic construct
  source 1..21: mol_type = other RNA
tcaaggtctacgcctattaca

SEQ ID NO: 1007 - RNA, 21 nt, synthetic construct
  source 1..21: mol_type = other RNA
caaggtctacgcctattacaa

SEQ ID NO: 1008 - RNA, 21 nt, synthetic construct
  source 1..21: mol_type = other RNA
aaggtctacgcctattacaaa

SEQ ID NO: 1009 - RNA, 21 nt, synthetic construct
  source 1..21: mol_type = other RNA
aggtctacgcctattacaaca

SEQ ID NO: 1010 - RNA, 21 nt, synthetic construct
  source 1..21: mol_type = other RNA
gtctacgcctattacaaccta

SEQ ID NO: 1011 - RNA, 21 nt, synthetic construct
  source 1..21: mol_type = other RNA
tctacgcctattacaacctga

SEQ ID NO: 1012 - RNA, 21 nt, synthetic construct
  source 1..21: mol_type = other RNA
ggagtggactatgtgtacaaa

SEQ ID NO: 1013 - RNA, 21 nt, synthetic construct
  source 1..21: mol_type = other RNA
agtggactatgtgtacaagaa

SEQ ID NO: 1014 - RNA, 21 nt, synthetic construct
  source 1..21: mol_type = other RNA
gtggactatgtgtacaagaca

SEQ ID NO: 1015 - RNA, 21 nt, synthetic construct
  source 1..21: mol_type = other RNA
tggactatgtgtacaagacca

SEQ ID NO: 1016 - RNA, 21 nt, synthetic construct
  source 1..21: mol_type = other RNA
agctgtccaatgactttgaca

SEQ ID NO: 1017 - RNA, 21 nt, synthetic construct
  source 1..21: mol_type = other RNA
gctgtccaatgactttgacga

SEQ ID NO: 1018 - RNA, 21 nt, synthetic construct
  source 1..21: mol_type = other RNA
gagaaccagaaacaatgccaa

SEQ ID NO: 1019 - RNA, 21 nt, synthetic construct
  source 1..21: mol_type = other RNA
agcatggttgtctttgggtga

SEQ ID NO: 1020 - RNA, 23 nt, synthetic construct
  source 1..23: mol_type = other RNA
tagagagaagaccttgaccacgt

SEQ ID NO: 1021 - RNA, 23 nt, synthetic construct
  source 1..23: mol_type = other RNA
ttctgtctggatgaagaggtacc

SEQ ID NO: 1022 - RNA, 23 nt, synthetic construct
  source 1..23: mol_type = other RNA
ttcttggtgaagtggatctggta

SEQ ID NO: 1023 - RNA, 23 nt, synthetic construct
  source 1..23: mol_type = other RNA
ttctggatgaagaggtacccgct

SEQ ID NO: 1024 - RNA, 23 nt, synthetic construct
  source 1..23: mol_type = other RNA
tctgtctggatgaagaggtaccc

SEQ ID NO: 1025 - RNA, 23 nt, synthetic construct
  source 1..23: mol_type = other RNA
ttggtcttgtctgtctggatgaa

SEQ ID NO: 1026 - RNA, 23 nt, synthetic construct
  source 1..23: mol_type = other RNA
tagatggtcttgtctgtctggat

SEQ ID NO: 1027 - RNA, 23 nt, synthetic construct
  source 1..23: mol_type = other RNA
tgtagatggtcttgtctgtctgg

SEQ ID NO: 1028 - RNA, 23 nt, synthetic construct
  source 1..23: mol_type = other RNA
tgtgtagatggtcttgtctgtct

SEQ ID NO: 1029 - RNA, 23 nt, synthetic construct
  source 1..23: mol_type = other RNA
ttgtagatggtcttgtctgtctg

SEQ ID NO: 1030 - RNA, 23 nt, synthetic construct
  source 1..23: mol_type = other RNA
ttcaatgttgaccatgaccgtcc

SEQ ID NO: 1031 - RNA, 23 nt, synthetic construct
  source 1..23: mol_type = other RNA
tacgagttccggaatgtcccaag

SEQ ID NO: 1032 - RNA, 23 nt, synthetic construct
  source 1..23: mol_type = other RNA
tatgttgacgagttccggaatgt

SEQ ID NO: 1033 - RNA, 23 nt, synthetic construct
  source 1..23: mol_type = other RNA
tttcatagtaggctcggatcttc

SEQ ID NO: 1034 - RNA, 23 nt, synthetic construct
  source 1..23: mol_type = other RNA
ttttcatagtaggctcggatctt

SEQ ID NO: 1035 - RNA, 23 nt, synthetic construct
  source 1..23: mol_type = other RNA
tactcagtggagaagacctgctg

SEQ ID NO: 1036 - RNA, 23 nt, synthetic construct
  source 1..23: mol_type = other RNA
tccttcacctcaaactcagtgga

SEQ ID NO: 1037 - RNA, 23 nt, synthetic construct
  source 1..23: mol_type = other RNA
ttccttcacctcaaactcagtgg

SEQ ID NO: 1038 - RNA, 23 nt, synthetic construct
  source 1..23: mol_type = other RNA
tctatgacctcgaaactgggcag

SEQ ID NO: 1039 - RNA, 23 nt, synthetic construct
  source 1..23: mol_type = other RNA
tcactatgacctcgaaactgggc

SEQ ID NO: 1040 - RNA, 23 nt, synthetic construct
  source 1..23: mol_type = other RNA
tgttatagatgtagtagaatttc

SEQ ID NO: 1041 - RNA, 23 nt, synthetic construct
  source 1..23: mol_type = other RNA
tccgaagatgacaaaggcagttc

SEQ ID NO: 1042 - RNA, 23 nt, synthetic construct
  source 1..23: mol_type = other RNA
ttgaagtggatctggtagggaga

SEQ ID NO: 1043 - RNA, 23 nt, synthetic construct
  source 1..23: mol_type = other RNA
tgtgaagtggatctggtagggag

SEQ ID NO: 1044 - RNA, 23 nt, synthetic construct
  source 1..23: mol_type = other RNA
ttggtgaagtggatctggtaggg

SEQ ID NO: 1045 - RNA, 23 nt, synthetic construct
  source 1..23: mol_type = other RNA
tttggtgaagtggatctggtagg

SEQ ID NO: 1046 - RNA, 23 nt, synthetic construct
  source 1..23: mol_type = other RNA
tttcgtcacgaacaccatgaggt

SEQ ID NO: 1047 - RNA, 23 nt, synthetic construct
  source 1..23: mol_type = other RNA
tgtaattgttggagttgcccacg

SEQ ID NO: 1048 - RNA, 23 nt, synthetic construct
  source 1..23: mol_type = other RNA
tggtaattgttggagttgcccac

SEQ ID NO: 1049 - RNA, 23 nt, synthetic construct
  source 1..23: mol_type = other RNA
taggtaattgttggagttgccca

SEQ ID NO: 1050 - RNA, 23 nt, synthetic construct
  source 1..23: mol_type = other RNA
tcaggtaattgttggagttgccc

SEQ ID NO: 1051 - RNA, 23 nt, synthetic construct
  source 1..23: mol_type = other RNA
tgcaggtaattgttggagttgcc

SEQ ID NO: 1052 - RNA, 23 nt, synthetic construct
  source 1..23: mol_type = other RNA
tagagatgcaggtaattgttgga

SEQ ID NO: 1053 - RNA, 23 nt, synthetic construct
  source 1..23: mol_type = other RNA
tattcgcaggaggaagttgacgt

SEQ ID NO: 1054 - RNA, 23 nt, synthetic construct
  source 1..23: mol_type = other RNA
taggtgtagtagcggatcttggc

SEQ ID NO: 1055 - RNA, 23 nt, synthetic construct
  source 1..23: mol_type = other RNA
ttcttattcagcacgaacacgcc

SEQ ID NO: 1056 - RNA, 23 nt, synthetic construct
  source 1..23: mol_type = other RNA
tcttcttattcagcacgaacacg

SEQ ID NO: 1057 - RNA, 23 nt, synthetic construct
  source 1..23: mol_type = other RNA
ttcttcttattcagcacgaacac

SEQ ID NO: 1058 - RNA, 23 nt, synthetic construct
  source 1..23: mol_type = other RNA
tttcttcttattcagcacgaaca

SEQ ID NO: 1059 - RNA, 23 nt, synthetic construct
  source 1..23: mol_type = other RNA
ttgttcttcttattcagcacgaa

SEQ ID NO: 1060 - RNA, 23 nt, synthetic construct
  source 1..23: mol_type = other RNA
tttgttcttcttattcagcacga

SEQ ID NO: 1061 - RNA, 23 nt, synthetic construct
  source 1..23: mol_type = other RNA
tgatcttactctgcgtcagtttg

SEQ ID NO: 1062 - RNA, 23 nt, synthetic construct
  source 1..23: mol_type = other RNA
tagatcttactctgcgtcagttt

SEQ ID NO: 1063 - RNA, 23 nt, synthetic construct
  source 1..23: mol_type = other RNA
taaacgatgttctcttctgcaat

SEQ ID NO: 1064 - RNA, 23 nt, synthetic construct
  source 1..23: mol_type = other RNA
tcgggaaacgatgttctcttctg

SEQ ID NO: 1065 - RNA, 23 nt, synthetic construct
  source 1..23: mol_type = other RNA
ttcgggaaacgatgttctcttct

SEQ ID NO: 1066 - RNA, 23 nt, synthetic construct
  source 1..23: mol_type = other RNA
tacttcgggaaacgatgttctct

SEQ ID NO: 1067 - RNA, 23 nt, synthetic construct
  source 1..23: mol_type = other RNA
tcacttcgggaaacgatgttctc

SEQ ID NO: 1068 - RNA, 23 nt, synthetic construct
  source 1..23: mol_type = other RNA
ttcacttcgggaaacgatgttct

SEQ ID NO: 1069 - RNA, 23 nt, synthetic construct
  source 1..23: mol_type = other RNA
ttccctttcttgtccgacatgct

SEQ ID NO: 1070 - RNA, 23 nt, synthetic construct
  source 1..23: mol_type = other RNA
tatccctttcttgtccgacatgc

SEQ ID NO: 1071 - RNA, 23 nt, synthetic construct
  source 1..23: mol_type = other RNA
tagatccctttcttgtccgacat

SEQ ID NO: 1072 - RNA, 23 nt, synthetic construct
  source 1..23: mol_type = other RNA
tacagatccctttcttgtccgac

SEQ ID NO: 1073 - RNA, 23 nt, synthetic construct
  source 1..23: mol_type = other RNA
tcacagatccctttcttgtccga

SEQ ID NO: 1074 - RNA, 23 nt, synthetic construct
  source 1..23: mol_type = other RNA
tacacagatccctttcttgtccg

SEQ ID NO: 1075 - RNA, 23 nt, synthetic construct
  source 1..23: mol_type = other RNA
tcacacagatccctttcttgtcc

SEQ ID NO: 1076 - RNA, 23 nt, synthetic construct
  source 1..23: mol_type = other RNA
tccacacagatccctttcttgtc

SEQ ID NO: 1077 - RNA, 23 nt, synthetic construct
  source 1..23: mol_type = other RNA
tgccacacagatccctttcttgt

SEQ ID NO: 1078 - RNA, 23 nt, synthetic construct
  source 1..23: mol_type = other RNA
tctgccacacagatccctttctt

SEQ ID NO: 1079 - RNA, 23 nt, synthetic construct
  source 1..23: mol_type = other RNA
tgcattactgtgacctcgaaggg

SEQ ID NO: 1080 - RNA, 23 nt, synthetic construct
  source 1..23: mol_type = other RNA
ttgcattactgtgacctcgaagg

SEQ ID NO: 1081 - RNA, 23 nt, synthetic construct
  source 1..23: mol_type = other RNA
taagaagtcctgcattactgtga

SEQ ID NO: 1082 - RNA, 23 nt, synthetic construct
  source 1..23: mol_type = other RNA
ttgaagaagtcctgcattactgt

SEQ ID NO: 1083 - RNA, 23 nt, synthetic construct
  source 1..23: mol_type = other RNA
tatgaagaagtcctgcattactg

SEQ ID NO: 1084 - RNA, 23 nt, synthetic construct
  source 1..23: mol_type = other RNA
taacaacagagtagggtagccgc

SEQ ID NO: 1085 - RNA, 23 nt, synthetic construct
  source 1..23: mol_type = other RNA
tcgaacaacagagtagggtagcc

SEQ ID NO: 1086 - RNA, 23 nt, synthetic construct
  source 1..23: mol_type = other RNA
ttcgaacaacagagtagggtagc

SEQ ID NO: 1087 - RNA, 23 nt, synthetic construct
  source 1..23: mol_type = other RNA
tttcgaacaacagagtagggtag

SEQ ID NO: 1088 - RNA, 23 nt, synthetic construct
  source 1..23: mol_type = other RNA
ttttcgaacaacagagtagggta

SEQ ID NO: 1089 - RNA, 23 nt, synthetic construct
  source 1..23: mol_type = other RNA
tgtttcgaacaacagagtagggt

SEQ ID NO: 1090 - RNA, 23 nt, synthetic construct
  source 1..23: mol_type = other RNA
tcgtttcgaacaacagagtaggg

SEQ ID NO: 1091 - RNA, 23 nt, synthetic construct
  source 1..23: mol_type = other RNA
ttcgtttcgaacaacagagtagg

SEQ ID NO: 1092 - RNA, 23 nt, synthetic construct
  source 1..23: mol_type = other RNA
tctcgtttcgaacaacagagtag

SEQ ID NO: 1093 - RNA, 23 nt, synthetic construct
  source 1..23: mol_type = other RNA
tgctcgtttcgaacaacagagta

SEQ ID NO: 1094 - RNA, 23 nt, synthetic construct
  source 1..23: mol_type = other RNA
tattgtagagaacggctcggatt

SEQ ID NO: 1095 - RNA, 23 nt, synthetic construct
  source 1..23: mol_type = other RNA
taattgtagagaacggctcggat

SEQ ID NO: 1096 - RNA, 23 nt, synthetic construct
  source 1..23: mol_type = other RNA
ttaattgtagagaacggctcgga

SEQ ID NO: 1097 - RNA, 23 nt, synthetic construct
  source 1..23: mol_type = other RNA
tgtaattgtagagaacggctcgg

SEQ ID NO: 1098 - RNA, 23 nt, synthetic construct
  source 1..23: mol_type = other RNA
tccggtaattgtagagaacggct

SEQ ID NO: 1099 - RNA, 23 nt, synthetic construct
  source 1..23: mol_type = other RNA
tgattgtggagtagttccaccct

SEQ ID NO: 1100 - RNA, 23 nt, synthetic construct
  source 1..23: mol_type = other RNA
tcgaacagccacagttttgttca

SEQ ID NO: 1101 - RNA, 23 nt, synthetic construct
  source 1..23: mol_type = other RNA
taattctggtctcagactcggtg

SEQ ID NO: 1102 - RNA, 23 nt, synthetic construct
  source 1..23: mol_type = other RNA
tggtaatgcacagcgatgaccgt

SEQ ID NO: 1103 - RNA, 23 nt, synthetic construct
  source 1..23: mol_type = other RNA
taggtaatgcacagcgatgaccg

SEQ ID NO: 1104 - RNA, 23 nt, synthetic construct
  source 1..23: mol_type = other RNA
tgtttcatccaggtaatgcacag

SEQ ID NO: 1105 - RNA, 23 nt, synthetic construct
  source 1..23: mol_type = other RNA
tcgtttcatccaggtaatgcaca

SEQ ID NO: 1106 - RNA, 23 nt, synthetic construct
  source 1..23: mol_type = other RNA
tagaagaccttgaccacgtaggc

SEQ ID NO: 1107 - RNA, 23 nt, synthetic construct
  source 1..23: mol_type = other RNA
tgagagaagaccttgaccacgta

SEQ ID NO: 1108 - RNA, 23 nt, synthetic construct
  source 1..23: mol_type = other RNA
ttcatttcttggtgtatcacggg

SEQ ID NO: 1109 - RNA, 23 nt, synthetic construct
  source 1..23: mol_type = other RNA
tcgagatgagaacaaaggccgtg

SEQ ID NO: 1110 - RNA, 23 nt, synthetic construct
  source 1..23: mol_type = other RNA
tgcgagatgagaacaaaggccgt

SEQ ID NO: 1111 - RNA, 23 nt, synthetic construct
  source 1..23: mol_type = other RNA
tagcgagatgagaacaaaggccg

SEQ ID NO: 1112 - RNA, 23 nt, synthetic construct
  source 1..23: mol_type = other RNA
ttagttggcttcaaggaagtctc

SEQ ID NO: 1113 - RNA, 23 nt, synthetic construct
  source 1..23: mol_type = other RNA
tatgtagttggcttcaaggaagt

SEQ ID NO: 1114 - RNA, 23 nt, synthetic construct
  source 1..23: mol_type = other RNA
ttaggttcatgtagttggcttca

SEQ ID NO: 1115 - RNA, 23 nt, synthetic construct
  source 1..23: mol_type = other RNA
tgtaggttcatgtagttggcttc

SEQ ID NO: 1116 - RNA, 23 nt, synthetic construct
  source 1..23: mol_type = other RNA
ttctgtaggttcatgtagttggc

SEQ ID NO: 1117 - RNA, 23 nt, synthetic construct
  source 1..23: mol_type = other RNA
tgaaatttgttaagaagaggccc

SEQ ID NO: 1118 - RNA, 23 nt, synthetic construct
  source 1..23: mol_type = other RNA
tatctttggctgtggtcagaaat

SEQ ID NO: 1119 - RNA, 23 nt, synthetic construct
  source 1..23: mol_type = other RNA
tgttcttatctttggctgtggtc

SEQ ID NO: 1120 - RNA, 23 nt, synthetic construct
  source 1..23: mol_type = other RNA
taagtcttttagctgcagtaggg

SEQ ID NO: 1121 - RNA, 23 nt, synthetic construct
  source 1..23: mol_type = other RNA
tgtcaaagtcttttagctgcagt

SEQ ID NO: 1122 - RNA, 23 nt, synthetic construct
  source 1..23: mol_type = other RNA
tttcattgagccaacgcacgacg

SEQ ID NO: 1123 - RNA, 23 nt, synthetic construct
  source 1..23: mol_type = other RNA
tgttcattgagccaacgcacgac

SEQ ID NO: 1124 - RNA, 23 nt, synthetic construct
  source 1..23: mol_type = other RNA
ttgttcattgagccaacgcacga

SEQ ID NO: 1125 - RNA, 23 nt, synthetic construct
  source 1..23: mol_type = other RNA
tcgtagtatctctgttcattgag

SEQ ID NO: 1126 - RNA, 23 nt, synthetic construct
  source 1..23: mol_type = other RNA
tccgtagtatctctgttcattga

SEQ ID NO: 1127 - RNA, 23 nt, synthetic construct
  source 1..23: mol_type = other RNA
taccgtagtatctctgttcattg

SEQ ID NO: 1128 - RNA, 23 nt, synthetic construct
  source 1..23: mol_type = other RNA
taaggcttggaacaccatgaagg

SEQ ID NO: 1129 - RNA, 23 nt, synthetic construct
  source 1..23: mol_type = other RNA
tggtattgagccaaggcttggaa

SEQ ID NO: 1130 - RNA, 23 nt, synthetic construct
  source 1..23: mol_type = other RNA
ttggtattgagccaaggcttgga

SEQ ID NO: 1131 - RNA, 23 nt, synthetic construct
  source 1..23: mol_type = other RNA
ttttggtattgagccaaggcttg

SEQ ID NO: 1132 - RNA, 23 nt, synthetic construct
  source 1..23: mol_type = other RNA
tattcccagtggatacggtgggt

SEQ ID NO: 1133 - RNA, 23 nt, synthetic construct
  source 1..23: mol_type = other RNA
tttggtctcttctgatcgcagga

SEQ ID NO: 1134 - RNA, 23 nt, synthetic construct
  source 1..23: mol_type = other RNA
tcttggtctcttctgatcgcagg

SEQ ID NO: 1135 - RNA, 23 nt, synthetic construct
  source 1..23: mol_type = other RNA
tgaaaccctcattttccttggtc

SEQ ID NO: 1136 - RNA, 23 nt, synthetic construct
  source 1..23: mol_type = other RNA
tgtgaaaccctcattttccttgg

SEQ ID NO: 1137 - RNA, 23 nt, synthetic construct
  source 1..23: mol_type = other RNA
tgaatttattacaggtgagttga

SEQ ID NO: 1138 - RNA, 23 nt, synthetic construct
  source 1..23: mol_type = other RNA
tcgaatttattacaggtgagttg

SEQ ID NO: 1139 - RNA, 23 nt, synthetic construct
  source 1..23: mol_type = other RNA
ttcgaatttattacaggtgagtt

SEQ ID NO: 1140 - RNA, 23 nt, synthetic construct
  source 1..23: mol_type = other RNA
taggtcgaatttattacaggtga

SEQ ID NO: 1141 - RNA, 23 nt, synthetic construct
  source 1..23: mol_type = other RNA
tgaggtcgaatttattacaggtg

SEQ ID NO: 1142 - RNA, 23 nt, synthetic construct
  source 1..23: mol_type = other RNA
ttgaggtcgaatttattacaggt

SEQ ID NO: 1143 - RNA, 23 nt, synthetic construct
  source 1..23: mol_type = other RNA
tccttgaggtcgaatttattaca

SEQ ID NO: 1144 - RNA, 23 nt, synthetic construct
  source 1..23: mol_type = other RNA
ttttatggtgaccttgaggtcga

SEQ ID NO: 1145 - RNA, 23 nt, synthetic construct
  source 1..23: mol_type = other RNA
tttttatggtgaccttgaggtcg

SEQ ID NO: 1146 - RNA, 23 nt, synthetic construct
  source 1..23: mol_type = other RNA
tgttttatggtgaccttgaggtc

SEQ ID NO: 1147 - RNA, 23 nt, synthetic construct
  source 1..23: mol_type = other RNA
tggttttatggtgaccttgaggt

SEQ ID NO: 1148 - RNA, 23 nt, synthetic construct
  source 1..23: mol_type = other RNA
ttggttttatggtgaccttgagg

SEQ ID NO: 1149 - RNA, 23 nt, synthetic construct
  source 1..23: mol_type = other RNA
tcatagtgttcttggcatcctga

SEQ ID NO: 1150 - RNA, 23 nt, synthetic construct
  source 1..23: mol_type = other RNA
tatcatagtgttcttggcatcct

SEQ ID NO: 1151 - RNA, 23 nt, synthetic construct
  source 1..23: mol_type = other RNA
ttatagacatagtggcatcctgg

SEQ ID NO: 1152 - RNA, 23 nt, synthetic construct
  source 1..23: mol_type = other RNA
tcatacttggagatgtatctgtc

SEQ ID NO: 1153 - RNA, 23 nt, synthetic construct
  source 1..23: mol_type = other RNA
tatcggagaaggctttgtccagc

SEQ ID NO: 1154 - RNA, 23 nt, synthetic construct
  source 1..23: mol_type = other RNA
ttagatgatgagggtgttcctat

SEQ ID NO: 1155 - RNA, 23 nt, synthetic construct
  source 1..23: mol_type = other RNA
tgtagatgatgagggtgttccta

SEQ ID NO: 1156 - RNA, 23 nt, synthetic construct
  source 1..23: mol_type = other RNA
taggtagatgatgagggtgttcc

SEQ ID NO: 1157 - RNA, 23 nt, synthetic construct
  source 1..23: mol_type = other RNA
tggtgaactttgaaagctagaca

SEQ ID NO: 1158 - RNA, 23 nt, synthetic construct
  source 1..23: mol_type = other RNA
ttggtgaactttgaaagctagac

SEQ ID NO: 1159 - RNA, 23 nt, synthetic construct
  source 1..23: mol_type = other RNA
tggataagctctacattaaagta

SEQ ID NO: 1160 - RNA, 23 nt, synthetic construct
  source 1..23: mol_type = other RNA
ttggataagctctacattaaagt

SEQ ID NO: 1161 - RNA, 23 nt, synthetic construct
  source 1..23: mol_type = other RNA
taataggcgtagaccttgactgc

SEQ ID NO: 1162 - RNA, 23 nt, synthetic construct
  source 1..23: mol_type = other RNA
tgtaataggcgtagaccttgact

SEQ ID NO: 1163 - RNA, 23 nt, synthetic construct
  source 1..23: mol_type = other RNA
ttgtaataggcgtagaccttgac

SEQ ID NO: 1164 - RNA, 23 nt, synthetic construct
  source 1..23: mol_type = other RNA
tttgtaataggcgtagaccttga

SEQ ID NO: 1165 - RNA, 23 nt, synthetic construct
  source 1..23: mol_type = other RNA
tgttgtaataggcgtagaccttg

SEQ ID NO: 1166 - RNA, 23 nt, synthetic construct
  source 1..23: mol_type = other RNA
taggttgtaataggcgtagacct

SEQ ID NO: 1167 - RNA, 23 nt, synthetic construct
  source 1..23: mol_type = other RNA
tcaggttgtaataggcgtagacc

SEQ ID NO: 1168 - RNA, 23 nt, synthetic construct
  source 1..23: mol_type = other RNA
tttgtacacatagtccactcctg

SEQ ID NO: 1169 - RNA, 23 nt, synthetic construct
  source 1..23: mol_type = other RNA
ttcttgtacacatagtccactcc

SEQ ID NO: 1170 - RNA, 23 nt, synthetic construct
  source 1..23: mol_type = other RNA
tgtcttgtacacatagtccactc

SEQ ID NO: 1171 - RNA, 23 nt, synthetic construct
  source 1..23: mol_type = other RNA
tggtcttgtacacatagtccact

SEQ ID NO: 1172 - RNA, 23 nt, synthetic construct
  source 1..23: mol_type = other RNA
tgtcaaagtcattggacagctga

SEQ ID NO: 1173 - RNA, 23 nt, synthetic construct
  source 1..23: mol_type = other RNA
tcgtcaaagtcattggacagctg

SEQ ID NO: 1174 - RNA, 23 nt, synthetic construct
  source 1..23: mol_type = other RNA
ttggcattgtttctggttctctt

SEQ ID NO: 1175 - RNA, 23 nt, synthetic construct
  source 1..23: mol_type = other RNA
tcacccaaagacaaccatgctct

SEQ ID NO: 1176 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gtggtcaaggtcttctctcta

SEQ ID NO: 1177 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
tacctcttcatccagacagaa

SEQ ID NO: 1178 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ccagatccacttcaccaagaa

SEQ ID NO: 1179 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
cgggtacctcttcatccagaa

SEQ ID NO: 1180 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
gtacctcttcatccagacaga

SEQ ID NO: 1181 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
catccagacagacaagaccaa

SEQ ID NO: 1182 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ccagacagacaagaccatcta

SEQ ID NO: 1183 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
agacagacaagaccatctaca

SEQ ID NO: 1184 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
acagacaagaccatctacaca

SEQ ID NO: 1185 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
gacagacaagaccatctacaa

SEQ ID NO: 1186 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
acggtcatggtcaacattgaa

SEQ ID NO: 1187 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
tgggacattccggaactcgta

SEQ ID NO: 1188 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
attccggaactcgtcaacata

SEQ ID NO: 1189 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
agatccgagcctactatgaaa

SEQ ID NO: 1190 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
gatccgagcctactatgaaaa

SEQ ID NO: 1191 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gcaggtcttctccactgagta

SEQ ID NO: 1192 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
cactgagtttgaggtgaagga

SEQ ID NO: 1193 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
actgagtttgaggtgaaggaa

SEQ ID NO: 1194 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
gcccagtttcgaggtcataga

SEQ ID NO: 1195 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
ccagtttcgaggtcatagtga

SEQ ID NO: 1196 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
aattctactacatctataaca

SEQ ID NO: 1197 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
actgcctttgtcatcttcgga

SEQ ID NO: 1198 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
tccctaccagatccacttcaa

SEQ ID NO: 1199 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ccctaccagatccacttcaca

SEQ ID NO: 1200 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ctaccagatccacttcaccaa

SEQ ID NO: 1201 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
taccagatccacttcaccaaa

SEQ ID NO: 1202 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ctcatggtgttcgtgacgaaa

SEQ ID NO: 1203 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
tgggcaactccaacaattaca

SEQ ID NO: 1204 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
gggcaactccaacaattacca

SEQ ID NO: 1205 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ggcaactccaacaattaccta

SEQ ID NO: 1206 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
gcaactccaacaattacctga

SEQ ID NO: 1207 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
caactccaacaattacctgca

SEQ ID NO: 1208 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
caacaattacctgcatctcta

SEQ ID NO: 1209 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gtcaacttcctcctgcgaata

SEQ ID NO: 1210 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
caagatccgctactacaccta

SEQ ID NO: 1211 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
cgtgttcgtgctgaataagaa

SEQ ID NO: 1212 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
tgttcgtgctgaataagaaga

SEQ ID NO: 1213 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
gttcgtgctgaataagaagaa

SEQ ID NO: 1214 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ttcgtgctgaataagaagaaa

SEQ ID NO: 1215 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
cgtgctgaataagaagaacaa

SEQ ID NO: 1216 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
gtgctgaataagaagaacaaa

SEQ ID NO: 1217 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
aataagaagaacaaactgaca

SEQ ID NO: 1218 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
aactgacgcagagtaagatca

SEQ ID NO: 1219 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
actgacgcagagtaagatcta

SEQ ID NO: 1220 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine
tgcagaagagaacatcgttta

SEQ ID NO: 1221 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
gaagagaacatcgtttcccga

SEQ ID NO: 1222 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
aagagaacatcgtttcccgaa

SEQ ID NO: 1223 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
agaacatcgtttcccgaagta

SEQ ID NO: 1224 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
gaacatcgtttcccgaagtga

SEQ ID NO: 1225 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
aacatcgtttcccgaagtgaa

SEQ ID NO: 1226 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
catgtcggacaagaaagggaa

SEQ ID NO: 1227 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
atgtcggacaagaaagggata

SEQ ID NO: 1228 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gtcggacaagaaagggatcta

SEQ ID NO: 1229 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
cggacaagaaagggatctgta

SEQ ID NO: 1230 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
ggacaagaaagggatctgtga

SEQ ID NO: 1231 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gacaagaaagggatctgtgta

SEQ ID NO: 1232 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
acaagaaagggatctgtgtga

SEQ ID NO: 1233 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
caagaaagggatctgtgtgga

SEQ ID NO: 1234 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
aagaaagggatctgtgtggca

SEQ ID NO: 1235 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
gaaagggatctgtgtggcaga

SEQ ID NO: 1236 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
cttcgaggtcacagtaatgca

SEQ ID NO: 1237 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ttcgaggtcacagtaatgcaa

SEQ ID NO: 1238 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine
acagtaatgcaggacttctta

SEQ ID NO: 1239 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
agtaatgcaggacttcttcaa

SEQ ID NO: 1240 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gtaatgcaggacttcttcata

SEQ ID NO: 1241 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ggctaccctactctgttgtta

SEQ ID NO: 1242 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
ctaccctactctgttgttcga

SEQ ID NO: 1243 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
taccctactctgttgttcgaa

SEQ ID NO: 1244 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
accctactctgttgttcgaaa

SEQ ID NO: 1245 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ccctactctgttgttcgaaaa

SEQ ID NO: 1246 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
cctactctgttgttcgaaaca

SEQ ID NO: 1247 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
ctactctgttgttcgaaacga

SEQ ID NO: 1248 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
tactctgttgttcgaaacgaa

SEQ ID NO: 1249 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
actctgttgttcgaaacgaga

SEQ ID NO: 1250 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ctctgttgttcgaaacgagca

SEQ ID NO: 1251 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
tccgagccgttctctacaata

SEQ ID NO: 1252 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ccgagccgttctctacaatta

SEQ ID NO: 1253 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
cgagccgttctctacaattaa

SEQ ID NO: 1254 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
gagccgttctctacaattaca

SEQ ID NO: 1255 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
ccgttctctacaattaccgga

SEQ ID NO: 1256 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ggtggaactactccacaatca

SEQ ID NO: 1257 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
aacaaaactgtggctgttcga

SEQ ID NO: 1258 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ccgagtctgagaccagaatta

SEQ ID NO: 1259 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ggtcatcgctgtgcattacca

SEQ ID NO: 1260 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gtcatcgctgtgcattaccta

SEQ ID NO: 1261 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
gtgcattacctggatgaaaca

SEQ ID NO: 1262 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
tgcattacctggatgaaacga

SEQ ID NO: 1263 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ctacgtggtcaaggtcttcta

SEQ ID NO: 1264 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
cgtggtcaaggtcttctctca

SEQ ID NO: 1265 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
cgtgatacaccaagaaatgaa

SEQ ID NO: 1266 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
cggcctttgttctcatctcga

SEQ ID NO: 1267 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ggcctttgttctcatctcgca

SEQ ID NO: 1268 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gcctttgttctcatctcgcta

SEQ ID NO: 1269 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
gacttccttgaagccaactaa

SEQ ID NO: 1270 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ttccttgaagccaactacata

SEQ ID NO: 1271 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
aagccaactacatgaacctaa

SEQ ID NO: 1272 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
agccaactacatgaacctaca

SEQ ID NO: 1273 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
caactacatgaacctacagaa

SEQ ID NO: 1274 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
gcctcttcttaacaaatttca

SEQ ID NO: 1275 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ttctgaccacagccaaagata

SEQ ID NO: 1276 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ccacagccaaagataagaaca

SEQ ID NO: 1277 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ctactgcagctaaaagactta

SEQ ID NO: 1278 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
tgcagctaaaagactttgaca

SEQ ID NO: 1279 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
tcgtgcgttggctcaatgaaa

SEQ ID NO: 1280 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
cgtgcgttggctcaatgaaca

SEQ ID NO: 1281 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
gtgcgttggctcaatgaacaa

SEQ ID NO: 1282 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
caatgaacagagatactacga

SEQ ID NO: 1283 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
aatgaacagagatactacgga

SEQ ID NO: 1284 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
atgaacagagatactacggta

SEQ ID NO: 1285 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ttcatggtgttccaagcctta

SEQ ID NO: 1286 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ccaagccttggctcaatacca

SEQ ID NO: 1287 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
caagccttggctcaataccaa

SEQ ID NO: 1288 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
agccttggctcaataccaaaa

SEQ ID NO: 1289 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
ccaccgtatccactgggaata

SEQ ID NO: 1290 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ctgcgatcagaagagaccaaa

SEQ ID NO: 1291 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
tgcgatcagaagagaccaaga

SEQ ID NO: 1292 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ccaaggaaaatgagggtttca

SEQ ID NO: 1293 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
aaggaaaatgagggtttcaca

SEQ ID NO: 1294 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
aactcacctgtaataaattca

SEQ ID NO: 1295 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
actcacctgtaataaattcga

SEQ ID NO: 1296 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ctcacctgtaataaattcgaa

SEQ ID NO: 1297 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
acctgtaataaattcgaccta

SEQ ID NO: 1298 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
cctgtaataaattcgacctca

SEQ ID NO: 1299 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ctgtaataaattcgacctcaa

SEQ ID NO: 1300 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
taataaattcgacctcaagga

SEQ ID NO: 1301 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
gacctcaaggtcaccataaaa

SEQ ID NO: 1302 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
acctcaaggtcaccataaaaa

SEQ ID NO: 1303 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
cctcaaggtcaccataaaaca

SEQ ID NO: 1304 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ctcaaggtcaccataaaacca

SEQ ID NO: 1305 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
tcaaggtcaccataaaaccaa

SEQ ID NO: 1306 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
aggatgccaagaacactatga

SEQ ID NO: 1307 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gatgccaagaacactatgata

SEQ ID NO: 1308 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
aggatgccactatgtctataa

SEQ ID NO: 1309 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
cagatacatctccaagtatga

SEQ ID NO: 1310 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
tggacaaagccttctccgata

SEQ ID NO: 1311 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
aggaacaccctcatcatctaa

SEQ ID NO: 1312 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ggaacaccctcatcatctaca

SEQ ID NO: 1313 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
aacaccctcatcatctaccta

SEQ ID NO: 1314 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
tctagctttcaaagttcacca

SEQ ID NO: 1315 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ctagctttcaaagttcaccaa

SEQ ID NO: 1316 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
ctttaatgtagagcttatcca

SEQ ID NO: 1317 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
tttaatgtagagcttatccaa

SEQ ID NO: 1318 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine
agtcaaggtctacgcctatta

SEQ ID NO: 1319 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
tcaaggtctacgcctattaca

SEQ ID NO: 1320 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
caaggtctacgcctattacaa

SEQ ID NO: 1321 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
aaggtctacgcctattacaaa

SEQ ID NO: 1322 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
aggtctacgcctattacaaca

SEQ ID NO: 1323 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gtctacgcctattacaaccta

SEQ ID NO: 1324 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
tctacgcctattacaacctga

SEQ ID NO: 1325 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
ggagtggactatgtgtacaaa

SEQ ID NO: 1326 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
agtggactatgtgtacaagaa

SEQ ID NO: 1327 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
gtggactatgtgtacaagaca

SEQ ID NO: 1328 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
tggactatgtgtacaagacca

SEQ ID NO: 1329 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine
agctgtccaatgactttgaca

SEQ ID NO: 1330 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
gctgtccaatgactttgacga

SEQ ID NO: 1331 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
gagaaccagaaacaatgccaa

SEQ ID NO: 1332 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-guanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine
agcatggttgtctttgggtga

SEQ ID NO: 1333 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tagagagaagaccttgaccacgt

SEQ ID NO: 1334 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttctgtctggatgaagaggtacc

SEQ ID NO: 1335 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
ttcttggtgaagtggatctggta

SEQ ID NO: 1336 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
ttctggatgaagaggtacccgct

SEQ ID NO: 1337 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tctgtctggatgaagaggtaccc

SEQ ID NO: 1338 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
ttggtcttgtctgtctggatgaa

SEQ ID NO: 1339 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tagatggtcttgtctgtctggat

SEQ ID NO: 1340 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tgtagatggtcttgtctgtctgg

SEQ ID NO: 1341 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tgtgtagatggtcttgtctgtct

SEQ ID NO: 1342 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
ttgtagatggtcttgtctgtctg

SEQ ID NO: 1343 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttcaatgttgaccatgaccgtcc

SEQ ID NO: 1344 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tacgagttccggaatgtcccaag

SEQ ID NO: 1345 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgttgacgagttccggaatgt

SEQ ID NO: 1346 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tttcatagtaggctcggatcttc

SEQ ID NO: 1347 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttttcatagtaggctcggatctt

SEQ ID NO: 1348 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tactcagtggagaagacctgctg

SEQ ID NO: 1349 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tccttcacctcaaactcagtgga

SEQ ID NO: 1350 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttccttcacctcaaactcagtgg

SEQ ID NO: 1351 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tctatgacctcgaaactgggcag

SEQ ID NO: 1352 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tcactatgacctcgaaactgggc

SEQ ID NO: 1353 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tgttatagatgtagtagaatttc

SEQ ID NO: 1354 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tccgaagatgacaaaggcagttc

SEQ ID NO: 1355 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
ttgaagtggatctggtagggaga

SEQ ID NO: 1356 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tgtgaagtggatctggtagggag

SEQ ID NO: 1357 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttggtgaagtggatctggtaggg

SEQ ID NO: 1358 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tttggtgaagtggatctggtagg

SEQ ID NO: 1359 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tttcgtcacgaacaccatgaggt

SEQ ID NO: 1360 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
tgtaattgttggagttgcccacg

SEQ ID NO: 1361 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tggtaattgttggagttgcccac

SEQ ID NO: 1362 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
taggtaattgttggagttgccca

SEQ ID NO: 1363 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tcaggtaattgttggagttgccc

SEQ ID NO: 1364 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tgcaggtaattgttggagttgcc

SEQ ID NO: 1365 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tagagatgcaggtaattgttgga

SEQ ID NO: 1366 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tattcgcaggaggaagttgacgt

SEQ ID NO: 1367 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
taggtgtagtagcggatcttggc

SEQ ID NO: 1368 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttcttattcagcacgaacacgcc

SEQ ID NO: 1369 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
tcttcttattcagcacgaacacg

SEQ ID NO: 1370 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
ttcttcttattcagcacgaacac

SEQ ID NO: 1371 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tttcttcttattcagcacgaaca

SEQ ID NO: 1372 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
ttgttcttcttattcagcacgaa

SEQ ID NO: 1373 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tttgttcttcttattcagcacga

SEQ ID NO: 1374 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tgtcagtttgttcttcttattca

SEQ ID NO: 1375 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tgatcttactctgcgtcagtttg

SEQ ID NO: 1376 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
tagatcttactctgcgtcagttt

SEQ ID NO: 1377 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
taaacgatgttctcttctgcaat

SEQ ID NO: 1378 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tcgggaaacgatgttctcttctg

SEQ ID NO: 1379 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
ttcgggaaacgatgttctcttct

SEQ ID NO: 1380 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tacttcgggaaacgatgttctct

SEQ ID NO: 1381 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcacttcgggaaacgatgttctc

SEQ ID NO: 1382 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
ttcacttcgggaaacgatgttct

SEQ ID NO: 1383 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
ttccctttcttgtccgacatgct

SEQ ID NO: 1384 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tatccctttcttgtccgacatgc

SEQ ID NO: 1385 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tagatccctttcttgtccgacat

SEQ ID NO: 1386 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tacagatccctttcttgtccgac

SEQ ID NO: 1387 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tcacagatccctttcttgtccga

SEQ ID NO: 1388 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
tacacagatccctttcttgtccg

SEQ ID NO: 1389 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tcacacagatccctttcttgtcc

SEQ ID NO: 1390 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tccacacagatccctttcttgtc

SEQ ID NO: 1391 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tgccacacagatccctttcttgt

SEQ ID NO: 1392 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
tctgccacacagatccctttctt

SEQ ID NO: 1393 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tgcattactgtgacctcgaaggg

SEQ ID NO: 1394 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttgcattactgtgacctcgaagg

SEQ ID NO: 1395 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
taagaagtcctgcattactgtga

SEQ ID NO: 1396 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
ttgaagaagtcctgcattactgt

SEQ ID NO: 1397 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tatgaagaagtcctgcattactg

SEQ ID NO: 1398 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
taacaacagagtagggtagccgc

SEQ ID NO: 1399 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tcgaacaacagagtagggtagcc

SEQ ID NO: 1400 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttcgaacaacagagtagggtagc

SEQ ID NO: 1401 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tttcgaacaacagagtagggtag

SEQ ID NO: 1402 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
ttttcgaacaacagagtagggta

SEQ ID NO: 1403 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tgtttcgaacaacagagtagggt

SEQ ID NO: 1404 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tcgtttcgaacaacagagtaggg

SEQ ID NO: 1405 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttcgtttcgaacaacagagtagg

SEQ ID NO: 1406 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tctcgtttcgaacaacagagtag

SEQ ID NO: 1407 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tgctcgtttcgaacaacagagta

SEQ ID NO: 1408 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
tattgtagagaacggctcggatt

SEQ ID NO: 1409 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
taattgtagagaacggctcggat

SEQ ID NO: 1410 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
ttaattgtagagaacggctcgga

SEQ ID NO: 1411 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tgtaattgtagagaacggctcgg

SEQ ID NO: 1412 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tccggtaattgtagagaacggct

SEQ ID NO: 1413 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tgattgtggagtagttccaccct

SEQ ID NO: 1414 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tcgaacagccacagttttgttca

SEQ ID NO: 1415 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
taattctggtctcagactcggtg

SEQ ID NO: 1416 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tggtaatgcacagcgatgaccgt

SEQ ID NO: 1417 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
taggtaatgcacagcgatgaccg

SEQ ID NO: 1418 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tgtttcatccaggtaatgcacag

SEQ ID NO: 1419 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tcgtttcatccaggtaatgcaca

SEQ ID NO: 1420 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tagaagaccttgaccacgtaggc

SEQ ID NO: 1421 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tgagagaagaccttgaccacgta

SEQ ID NO: 1422 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttcatttcttggtgtatcacggg

SEQ ID NO: 1423 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tcgagatgagaacaaaggccgtg

SEQ ID NO: 1424 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tgcgagatgagaacaaaggccgt

SEQ ID NO: 1425 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
tagcgagatgagaacaaaggccg

SEQ ID NO: 1426 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
ttagttggcttcaaggaagtctc

SEQ ID NO: 1427 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tatgtagttggcttcaaggaagt

SEQ ID NO: 1428 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
ttaggttcatgtagttggcttca

SEQ ID NO: 1429 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tgtaggttcatgtagttggcttc

SEQ ID NO: 1430 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttctgtaggttcatgtagttggc

SEQ ID NO: 1431 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tgaaatttgttaagaagaggccc

SEQ ID NO: 1432 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
tatctttggctgtggtcagaaat

SEQ ID NO: 1433 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tgttcttatctttggctgtggtc

SEQ ID NO: 1434 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
taagtcttttagctgcagtaggg

SEQ ID NO: 1435 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tgtcaaagtcttttagctgcagt

SEQ ID NO: 1436 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
tttcattgagccaacgcacgacg

SEQ ID NO: 1437 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
tgttcattgagccaacgcacgac

SEQ ID NO: 1438 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
ttgttcattgagccaacgcacga

SEQ ID NO: 1439 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tcgtagtatctctgttcattgag

SEQ ID NO: 1440 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tccgtagtatctctgttcattga

SEQ ID NO: 1441 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
taccgtagtatctctgttcattg

SEQ ID NO: 1442 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
taaggcttggaacaccatgaagg

SEQ ID NO: 1443 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tggtattgagccaaggcttggaa

SEQ ID NO: 1444 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
ttggtattgagccaaggcttgga

SEQ ID NO: 1445 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
ttttggtattgagccaaggcttg

SEQ ID NO: 1446 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tattcccagtggatacggtgggt

SEQ ID NO: 1447 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tttggtctcttctgatcgcagga

SEQ ID NO: 1448 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tcttggtctcttctgatcgcagg

SEQ ID NO: 1449 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tgaaaccctcattttccttggtc

SEQ ID NO: 1450 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorocytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tgtgaaaccctcattttccttgg

SEQ ID NO: 1451 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tgaatttattacaggtgagttga

SEQ ID NO: 1452 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tcgaatttattacaggtgagttg

SEQ ID NO: 1453 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttcgaatttattacaggtgagtt

SEQ ID NO: 1454 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
taggtcgaatttattacaggtga

SEQ ID NO: 1455 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tgaggtcgaatttattacaggtg

SEQ ID NO: 1456 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
ttgaggtcgaatttattacaggt

SEQ ID NO: 1457 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tccttgaggtcgaatttattaca

SEQ ID NO: 1458 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
ttttatggtgaccttgaggtcga

SEQ ID NO: 1459 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
tttttatggtgaccttgaggtcg

SEQ ID NO: 1460 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tgttttatggtgaccttgaggtc

SEQ ID NO: 1461 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
tggttttatggtgaccttgaggt

SEQ ID NO: 1462 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttggttttatggtgaccttgagg

SEQ ID NO: 1463 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tcatagtgttcttggcatcctga

SEQ ID NO: 1464 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tatcatagtgttcttggcatcct

SEQ ID NO: 1465 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
ttatagacatagtggcatcctgg

SEQ ID NO: 1466 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcatacttggagatgtatctgtc

SEQ ID NO: 1467 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
tatcggagaaggctttgtccagc

SEQ ID NO: 1468 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
ttagatgatgagggtgttcctat

SEQ ID NO: 1469 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroadenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tgtagatgatgagggtgttccta

SEQ ID NO: 1470 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
taggtagatgatgagggtgttcc

SEQ ID NO: 1471 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tggtgaactttgaaagctagaca

SEQ ID NO: 1472 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
ttggtgaactttgaaagctagac

SEQ ID NO: 1473 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
tggataagctctacattaaagta

SEQ ID NO: 1474 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
ttggataagctctacattaaagt

SEQ ID NO: 1475 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
taataggcgtagaccttgactgc

SEQ ID NO: 1476 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluoroguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tgtaataggcgtagaccttgact

SEQ ID NO: 1477 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
ttgtaataggcgtagaccttgac

SEQ ID NO: 1478 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tttgtaataggcgtagaccttga

SEQ ID NO: 1479 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tgttgtaataggcgtagaccttg

SEQ ID NO: 1480 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
taggttgtaataggcgtagacct

SEQ ID NO: 1481 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
tcaggttgtaataggcgtagacc

SEQ ID NO: 1482 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tttgtacacatagtccactcctg

SEQ ID NO: 1483 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
ttcttgtacacatagtccactcc

SEQ ID NO: 1484 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tgtcttgtacacatagtccactc

SEQ ID NO: 1485 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tggtcttgtacacatagtccact

SEQ ID NO: 1486 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
tgtcaaagtcattggacagctga

SEQ ID NO: 1487 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
tcgtcaaagtcattggacagctg

SEQ ID NO: 1488 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluoroadenosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttggcattgtttctggttctctt

SEQ ID NO: 1489 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
tcacccaaagacaaccatgctct

SEQ ID NO: 1490 - RNA, 21 nt, synthetic construct
  source 1..21: mol_type = other RNA
gtggtcaaggtcttctctcta

SEQ ID NO: 1491 - RNA, 21 nt, synthetic construct
  source 1..21: mol_type = other RNA
tacctcttcatccagacagaa

SEQ ID NO: 1492 - RNA, 21 nt, synthetic construct
  source 1..21: mol_type = other RNA
ccagatccacttcaccaagaa

SEQ ID NO: 1493 - RNA, 21 nt, synthetic construct
  source 1..21: mol_type = other RNA
cgggtacctcttcatccagac

SEQ ID NO: 1494 - RNA, 21 nt, synthetic construct
  source 1..21: mol_type = other RNA
gtacctcttcatccagacaga

SEQ ID NO: 1495 - RNA, 21 nt, synthetic construct
  source 1..21: mol_type = other RNA
catccagacagacaagaccat

SEQ ID NO: 1496 - RNA, 21 nt, synthetic construct
  source 1..21: mol_type = other RNA
ccagacagacaagaccatcta

SEQ ID NO: 1497 - RNA, 21 nt, synthetic construct
  source 1..21: mol_type = other RNA
agacagacaagaccatctaca

SEQ ID NO: 1498 - RNA, 21 nt, synthetic construct
  source 1..21: mol_type = other RNA
acagacaagaccatctacacc

SEQ ID NO: 1499 - RNA, 21 nt, synthetic construct
  source 1..21: mol_type = other RNA
gacagacaagaccatctacac

SEQ ID NO: 1500 - RNA, 21 nt, synthetic construct
  source 1..21: mol_type = other RNA
acggtcatggtcaacattgag

SEQ ID NO: 1501 - RNA, 21 nt, synthetic construct
  source 1..21: mol_type = other RNA
tgggacattccggaactcgtc

SEQ ID NO: 1502 - RNA, 21 nt, synthetic construct
  source 1..21: mol_type = other RNA
attccggaactcgtcaacatg

SEQ ID NO: 1503 - RNA, 21 nt, synthetic construct
  source 1..21: mol_type = other RNA
agatccgagcctactatgaaa

SEQ ID NO: 1504 - RNA, 21 nt, synthetic construct
  source 1..21: mol_type = other RNA
gatccgagcctactatgaaaa

SEQ ID NO: 1505 - RNA, 21 nt, synthetic construct
  source 1..21: mol_type = other RNA
gcaggtcttctccactgagtt

SEQ ID NO: 1506 - RNA, 21 nt, synthetic construct
  source 1..21: mol_type = other RNA
cactgagtttgaggtgaagga

SEQ ID NO: 1507 - RNA, 21 nt, synthetic construct
  source 1..21: mol_type = other RNA
actgagtttgaggtgaaggag

SEQ ID NO: 1508 - RNA, 21 nt, synthetic construct
  source 1..21: mol_type = other RNA
gcccagtttcgaggtcatagt

SEQ ID NO: 1509 - RNA, 21 nt, synthetic construct
  source 1..21: mol_type = other RNA
ccagtttcgaggtcatagtgg

SEQ ID NO: 1510 - RNA, 21 nt, synthetic construct
  source 1..21: mol_type = other RNA
aattctactacatctataacg

SEQ ID NO: 1511 - RNA, 21 nt, synthetic construct
  source 1..21: mol_type = other RNA
actgcctttgtcatcttcggg

SEQ ID NO: 1512 - RNA, 21 nt, synthetic construct
  source 1..21: mol_type = other RNA
tccctaccagatccacttcac

SEQ ID NO: 1513 - RNA, 21 nt, synthetic construct
  source 1..21: mol_type = other RNA
ccctaccagatccacttcacc

SEQ ID NO: 1514 - RNA, 21 nt, synthetic construct
  source 1..21: mol_type = other RNA
ctaccagatccacttcaccaa

SEQ ID NO: 1515 - RNA, 21 nt, synthetic construct
  source 1..21: mol_type = other RNA
taccagatccacttcaccaag

SEQ ID NO: 1516 - RNA, 21 nt, synthetic construct
  source 1..21: mol_type = other RNA
ctcatggtgttcgtgacgaac

SEQ ID NO: 1517 - RNA, 21 nt, synthetic construct
  source 1..21: mol_type = other RNA
tgggcaactccaacaattacc

SEQ ID NO: 1518 - RNA, 21 nt, synthetic construct
  source 1..21: mol_type = other RNA
gggcaactccaacaattacct

SEQ ID NO: 1519 - RNA, 21 nt, synthetic construct
  source 1..21: mol_type = other RNA
ggcaactccaacaattacctg

SEQ ID NO: 1520 - RNA, 21 nt, synthetic construct
  source 1..21: mol_type = other RNA
gcaactccaacaattacctgc

SEQ ID NO: 1521 - RNA, 21 nt, synthetic construct
  source 1..21: mol_type = other RNA
caactccaacaattacctgca

SEQ ID NO: 1522 - RNA, 21 nt, synthetic construct
  source 1..21: mol_type = other RNA
caacaattacctgcatctctc

SEQ ID NO: 1523 - RNA, 21 nt, synthetic construct
  source 1..21: mol_type = other RNA
gtcaacttcctcctgcgaatg

SEQ ID NO: 1524 - RNA, 21 nt, synthetic construct
  source 1..21: mol_type = other RNA
caagatccgctactacaccta

SEQ ID NO: 1525 - RNA, 21 nt, synthetic construct
  source 1..21: mol_type = other RNA
cgtgttcgtgctgaataagaa

SEQ ID NO: 1526 - RNA, 21 nt, synthetic construct
  source 1..21: mol_type = other RNA
tgttcgtgctgaataagaaga

SEQ ID NO: 1527 - RNA, 21 nt, synthetic construct
  source 1..21: mol_type = other RNA
gttcgtgctgaataagaagaa

SEQ ID NO: 1528 - RNA, 21 nt, synthetic construct
  source 1..21: mol_type = other RNA
ttcgtgctgaataagaagaac

SEQ ID NO: 1529 - RNA, 21 nt, synthetic construct
  source 1..21: mol_type = other RNA
cgtgctgaataagaagaacaa

SEQ ID NO: 1530 - RNA, 21 nt, synthetic construct
  source 1..21: mol_type = other RNA
gtgctgaataagaagaacaaa

SEQ ID NO: 1531 - RNA, 21 nt, synthetic construct
  source 1..21: mol_type = other RNA
aataagaagaacaaactgacg

SEQ ID NO: 1532 - RNA, 21 nt, synthetic construct
  source 1..21: mol_type = other RNA
aactgacgcagagtaagatct

SEQ ID NO: 1533 - RNA, 21 nt, synthetic construct
  source 1..21: mol_type = other RNA
actgacgcagagtaagatctg

SEQ ID NO: 1534 - RNA, 21 nt, synthetic construct
  source 1..21: mol_type = other RNA
tgcagaagagaacatcgtttc

SEQ ID NO: 1535 - RNA, 21 nt, synthetic construct
  source 1..21: mol_type = other RNA
gaagagaacatcgtttcccga

SEQ ID NO: 1536 - RNA, 21 nt, synthetic construct
  source 1..21: mol_type = other RNA
aagagaacatcgtttcccgaa

SEQ ID NO: 1537 - RNA, 21 nt, synthetic construct
  source 1..21: mol_type = other RNA
agaacatcgtttcccgaagtg

SEQ ID NO: 1538 - RNA, 21 nt, synthetic construct
  source 1..21: mol_type = other RNA
gaacatcgtttcccgaagtga

SEQ ID NO: 1539 - RNA, 21 nt, synthetic construct
  source 1..21: mol_type = other RNA
aacatcgtttcccgaagtgag

SEQ ID NO: 1540 - RNA, 21 nt, synthetic construct
  source 1..21: mol_type = other RNA
catgtcggacaagaaagggat

SEQ ID NO: 1541 - RNA, 21 nt, synthetic construct
  source 1..21: mol_type = other RNA
atgtcggacaagaaagggatc

SEQ ID NO: 1542 - RNA, 21 nt, synthetic construct
  source 1..21: mol_type = other RNA
gtcggacaagaaagggatctg

SEQ ID NO: 1543 - RNA, 21 nt, synthetic construct
  source 1..21: mol_type = other RNA
cggacaagaaagggatctgtg

SEQ ID NO: 1544 - RNA, 21 nt, synthetic construct
  source 1..21: mol_type = other RNA
ggacaagaaagggatctgtgt

SEQ ID NO: 1545 - RNA, 21 nt, synthetic construct
  source 1..21: mol_type = other RNA
gacaagaaagggatctgtgtg

SEQ ID NO: 1546 - RNA, 21 nt, synthetic construct
  source 1..21: mol_type = other RNA
acaagaaagggatctgtgtgg

SEQ ID NO: 1547 - RNA, 21 nt, synthetic construct
  source 1..21: mol_type = other RNA
caagaaagggatctgtgtggc

SEQ ID NO: 1548 - RNA, 21 nt, synthetic construct
  source 1..21: mol_type = other RNA
aagaaagggatctgtgtggca

SEQ ID NO: 1549 - RNA, 21 nt, synthetic construct
  source 1..21: mol_type = other RNA
gaaagggatctgtgtggcaga

SEQ ID NO: 1550 - RNA, 21 nt, synthetic construct
  source 1..21: mol_type = other RNA
cttcgaggtcacagtaatgca

SEQ ID NO: 1551 - RNA, 21 nt, synthetic construct
  source 1..21: mol_type = other RNA
ttcgaggtcacagtaatgcag

SEQ ID NO: 1552 - RNA, 21 nt, synthetic construct
  source 1..21: mol_type = other RNA
acagtaatgcaggacttcttc

SEQ ID NO: 1553 - RNA, 21 nt, synthetic construct
  source 1..21: mol_type = other RNA
agtaatgcaggacttcttcat

SEQ ID NO: 1554 - RNA, 21 nt, synthetic construct
  source 1..21: mol_type = other RNA
gtaatgcaggacttcttcatc

SEQ ID NO: 1555 - RNA, 21 nt, synthetic construct
  source 1..21: mol_type = other RNA
ggctaccctactctgttgttc

SEQ ID NO: 1556 - RNA, 21 nt, synthetic construct
  source 1..21: mol_type = other RNA
ctaccctactctgttgttcga

SEQ ID NO: 1557 - RNA, 21 nt, synthetic construct
  source 1..21: mol_type = other RNA
taccctactctgttgttcgaa

SEQ ID NO: 1558 - RNA, 21 nt, synthetic construct
  source 1..21: mol_type = other RNA
accctactctgttgttcgaaa

SEQ ID NO: 1559 - RNA, 21 nt, synthetic construct
  source 1..21: mol_type = other RNA
ccctactctgttgttcgaaac

SEQ ID NO: 1560 - RNA, 21 nt, synthetic construct
  source 1..21: mol_type = other RNA
cctactctgttgttcgaaacg

SEQ ID NO: 1561 - RNA, 21 nt, synthetic construct
  source 1..21: mol_type = other RNA
ctactctgttgttcgaaacga

SEQ ID NO: 1562 - RNA, 21 nt, synthetic construct
  source 1..21: mol_type = other RNA
tactctgttgttcgaaacgag

SEQ ID NO: 1563 - RNA, 21 nt, synthetic construct
  source 1..21: mol_type = other RNA
actctgttgttcgaaacgagc

SEQ ID NO: 1564 - RNA, 21 nt, synthetic construct
  source 1..21: mol_type = other RNA
ctctgttgttcgaaacgagca

SEQ ID NO: 1565 - RNA, 21 nt, synthetic construct
  source 1..21: mol_type = other RNA
tccgagccgttctctacaatt

SEQ ID NO: 1566 - RNA, 21 nt, synthetic construct
  source 1..21: mol_type = other RNA
ccgagccgttctctacaatta

SEQ ID NO: 1567 - RNA, 21 nt, synthetic construct
  source 1..21: mol_type = other RNA
cgagccgttctctacaattac

SEQ ID NO: 1568 - RNA, 21 nt, synthetic construct
  source 1..21: mol_type = other RNA
gagccgttctctacaattacc

SEQ ID NO: 1569 - RNA, 21 nt, synthetic construct
  source 1..21: mol_type = other RNA
ccgttctctacaattaccggc

SEQ ID NO: 1570 - RNA, 21 nt, synthetic construct
  source 1..21: mol_type = other RNA
ggtggaactactccacaatcc

SEQ ID NO: 1571 - RNA, 21 nt, synthetic construct
  source 1..21: mol_type = other RNA
aacaaaactgtggctgttcgc

SEQ ID NO: 1572 - RNA, 21 nt, synthetic construct
  source 1..21: mol_type = other RNA
ccgagtctgagaccagaattc

SEQ ID NO: 1573 - RNA, 21 nt, synthetic construct
  source 1..21: mol_type = other RNA
ggtcatcgctgtgcattacct

SEQ ID NO: 1574 - RNA, 21 nt, synthetic construct
  source 1..21: mol_type = other RNA
gtcatcgctgtgcattacctg

SEQ ID NO: 1575 - RNA, 21 nt, synthetic construct
  source 1..21: mol_type = other RNA
gtgcattacctggatgaaacg

SEQ ID NO: 1576 - RNA, 21 nt, synthetic construct
  source 1..21: mol_type = other RNA
tgcattacctggatgaaacgg

SEQ ID NO: 1577 - RNA, 21 nt, synthetic construct
  source 1..21: mol_type = other RNA
ctacgtggtcaaggtcttctc

SEQ ID NO: 1578 - RNA, 21 nt, synthetic construct
  source 1..21: mol_type = other RNA
cgtggtcaaggtcttctctca

SEQ ID NO: 1579 - RNA, 21 nt, synthetic construct
  source 1..21: mol_type = other RNA
cgtgatacaccaagaaatgat

SEQ ID NO: 1580 - RNA, 21 nt, synthetic construct
  source 1..21: mol_type = other RNA
cggcctttgttctcatctcgc

SEQ ID NO: 1581 - RNA, 21 nt, synthetic construct
  source 1..21: mol_type = other RNA
ggcctttgttctcatctcgct

SEQ ID NO: 1582 - RNA, 21 nt, synthetic construct
  source 1..21: mol_type = other RNA
gcctttgttctcatctcgctg

SEQ ID NO: 1583 - RNA, 21 nt, synthetic construct
  source 1..21: mol_type = other RNA
gacttccttgaagccaactac

SEQ ID NO: 1584 - RNA, 21 nt, synthetic construct
  source 1..21: mol_type = other RNA
ttccttgaagccaactacatg

SEQ ID NO: 1585 - RNA, 21 nt, synthetic construct
  source 1..21: mol_type = other RNA
aagccaactacatgaacctac

SEQ ID NO: 1586 - RNA, 21 nt, synthetic construct
  source 1..21: mol_type = other RNA
agccaactacatgaacctaca

SEQ ID NO: 1587 - RNA, 21 nt, synthetic construct
  source 1..21: mol_type = other RNA
caactacatgaacctacagag

SEQ ID NO: 1588 - RNA, 21 nt, synthetic construct
  source 1..21: mol_type = other RNA
gcctcttcttaacaaatttct

SEQ ID NO: 1589 - RNA, 21 nt, synthetic construct
  source 1..21: mol_type = other RNA
ttctgaccacagccaaagata

SEQ ID NO: 1590 - RNA, 21 nt, synthetic construct
  source 1..21: mol_type = other RNA
ccacagccaaagataagaacc

SEQ ID NO: 1591 - RNA, 21 nt, synthetic construct
  source 1..21: mol_type = other RNA
ctactgcagctaaaagacttt

SEQ ID NO: 1592 - RNA, 21 nt, synthetic construct
  source 1..21: mol_type = other RNA
tgcagctaaaagactttgact

SEQ ID NO: 1593 - RNA, 21 nt, synthetic construct
  source 1..21: mol_type = other RNA
tcgtgcgttggctcaatgaac

SEQ ID NO: 1594 - RNA, 21 nt, synthetic construct
  source 1..21: mol_type = other RNA
cgtgcgttggctcaatgaaca

SEQ ID NO: 1595 - RNA, 21 nt, synthetic construct
  source 1..21: mol_type = other RNA
gtgcgttggctcaatgaacag

SEQ ID NO: 1596 - RNA, 21 nt, synthetic construct
  source 1..21: mol_type = other RNA
caatgaacagagatactacgg

SEQ ID NO: 1597 - RNA, 21 nt, synthetic construct
  source 1..21: mol_type = other RNA
aatgaacagagatactacggt

SEQ ID NO: 1598 - RNA, 21 nt, synthetic construct
  source 1..21: mol_type = other RNA
atgaacagagatactacggtg

SEQ ID NO: 1599 - RNA, 21 nt, synthetic construct
  source 1..21: mol_type = other RNA
ttcatggtgttccaagccttg

SEQ ID NO: 1600 - RNA, 21 nt, synthetic construct
  source 1..21: mol_type = other RNA
ccaagccttggctcaatacca

SEQ ID NO: 1601 - RNA, 21 nt, synthetic construct
  source 1..21: mol_type = other RNA
caagccttggctcaataccaa

SEQ ID NO: 1602 - RNA, 21 nt, synthetic construct
  source 1..21: mol_type = other RNA
agccttggctcaataccaaaa

SEQ ID NO: 1603 - RNA, 21 nt, synthetic construct
  source 1..21: mol_type = other RNA
ccaccgtatccactgggaatc

SEQ ID NO: 1604 - RNA, 21 nt, synthetic construct
  source 1..21: mol_type = other RNA
ctgcgatcagaagagaccaag

SEQ ID NO: 1605 - RNA, 21 nt, synthetic construct
  source 1..21: mol_type = other RNA
tgcgatcagaagagaccaagg

SEQ ID NO: 1606 - RNA, 21 nt, synthetic construct
  source 1..21: mol_type = other RNA
ccaaggaaaatgagggtttca

SEQ ID NO: 1607 - RNA, 21 nt, synthetic construct
  source 1..21: mol_type = other RNA
aaggaaaatgagggtttcaca

SEQ ID NO: 1608 - RNA, 21 nt, synthetic construct
  source 1..21: mol_type = other RNA
aactcacctgtaataaattcg

SEQ ID NO: 1609 - RNA, 21 nt, synthetic construct
  source 1..21: mol_type = other RNA
actcacctgtaataaattcga

SEQ ID NO: 1610 - RNA, 21 nt, synthetic construct
  source 1..21: mol_type = other RNA
ctcacctgtaataaattcgac

SEQ ID NO: 1611 - RNA, 21 nt, synthetic construct
  source 1..21: mol_type = other RNA
acctgtaataaattcgacctc

SEQ ID NO: 1612 - RNA, 21 nt, synthetic construct
  source 1..21: mol_type = other RNA
cctgtaataaattcgacctca

SEQ ID NO: 1613 - RNA, 21 nt, synthetic construct
  source 1..21: mol_type = other RNA
ctgtaataaattcgacctcaa

SEQ ID NO: 1614 - RNA, 21 nt, synthetic construct
  source 1..21: mol_type = other RNA
taataaattcgacctcaaggt

SEQ ID NO: 1615 - RNA, 21 nt, synthetic construct
  source 1..21: mol_type = other RNA
gacctcaaggtcaccataaaa

SEQ ID NO: 1616 - RNA, 21 nt, synthetic construct
  source 1..21: mol_type = other RNA
acctcaaggtcaccataaaac

SEQ ID NO: 1617 - RNA, 21 nt, synthetic construct
  source 1..21: mol_type = other RNA
cctcaaggtcaccataaaacc

SEQ ID NO: 1618 - RNA, 21 nt, synthetic construct
  source 1..21: mol_type = other RNA
ctcaaggtcaccataaaacca

SEQ ID NO: 1619 - RNA, 21 nt, synthetic construct
  source 1..21: mol_type = other RNA
tcaaggtcaccataaaaccag

SEQ ID NO: 1620 - RNA, 21 nt, synthetic construct
  source 1..21: mol_type = other RNA
aggatgccaagaacactatga

SEQ ID NO: 1621 - RNA, 21 nt, synthetic construct
  source 1..21: mol_type = other RNA
gatgccaagaacactatgatc

SEQ ID NO: 1622 - RNA, 21 nt, synthetic construct
  source 1..21: mol_type = other RNA
aggatgccactatgtctatat

SEQ ID NO: 1623 - RNA, 21 nt, synthetic construct
  source 1..21: mol_type = other RNA
cagatacatctccaagtatga

SEQ ID NO: 1624 - RNA, 21 nt, synthetic construct
  source 1..21: mol_type = other RNA
tggacaaagccttctccgata

SEQ ID NO: 1625 - RNA, 21 nt, synthetic construct
  source 1..21: mol_type = other RNA
aggaacaccctcatcatctac

SEQ ID NO: 1626 - RNA, 21 nt, synthetic construct
  source 1..21: mol_type = other RNA
ggaacaccctcatcatctacc

SEQ ID NO: 1627 - RNA, 21 nt, synthetic construct
  source 1..21: mol_type = other RNA
aacaccctcatcatctacctg

SEQ ID NO: 1628 - RNA, 21 nt, synthetic construct
  source 1..21: mol_type = other RNA
tctagctttcaaagttcacca

SEQ ID NO: 1629 - RNA, 21 nt, synthetic construct
  source 1..21: mol_type = other RNA
ctagctttcaaagttcaccaa

SEQ ID NO: 1630 - RNA, 21 nt, synthetic construct
  source 1..21: mol_type = other RNA
ctttaatgtagagcttatcca

SEQ ID NO: 1631 - RNA, 21 nt, synthetic construct
  source 1..21: mol_type = other RNA
tttaatgtagagcttatccag

SEQ ID NO: 1632 - RNA, 21 nt, synthetic construct
  source 1..21: mol_type = other RNA
agtcaaggtctacgcctatta

SEQ ID NO: 1633 - RNA, 21 nt, synthetic construct
  source 1..21: mol_type = other RNA
tcaaggtctacgcctattaca

SEQ ID NO: 1634 - RNA, 21 nt, synthetic construct
  source 1..21: mol_type = other RNA
caaggtctacgcctattacaa

SEQ ID NO: 1635 - RNA, 21 nt, synthetic construct
  source 1..21: mol_type = other RNA
aaggtctacgcctattacaac

SEQ ID NO: 1636 - RNA, 21 nt, synthetic construct
  source 1..21: mol_type = other RNA
aggtctacgcctattacaacc

SEQ ID NO: 1637 - RNA, 21 nt, synthetic construct
  source 1..21: mol_type = other RNA
gtctacgcctattacaacctg

SEQ ID NO: 1638 - RNA, 21 nt, synthetic construct
  source 1..21: mol_type = other RNA
tctacgcctattacaacctgg

SEQ ID NO: 1639 - RNA, 21 nt, synthetic construct
  source 1..21: mol_type = other RNA
ggagtggactatgtgtacaag

SEQ ID NO: 1640 - RNA, 21 nt, synthetic construct
  source 1..21: mol_type = other RNA
agtggactatgtgtacaagac

SEQ ID NO: 1641 - RNA, 21 nt, synthetic construct
  source 1..21: mol_type = other RNA
gtggactatgtgtacaagacc

SEQ ID NO: 1642 - RNA, 21 nt, synthetic construct
  source 1..21: mol_type = other RNA
tggactatgtgtacaagaccc

SEQ ID NO: 1643 - RNA, 21 nt, synthetic construct
  source 1..21: mol_type = other RNA
agctgtccaatgactttgacg

SEQ ID NO: 1644 - RNA, 21 nt, synthetic construct
  source 1..21: mol_type = other RNA
gctgtccaatgactttgacga

SEQ ID NO: 1645 - RNA, 21 nt, synthetic construct
  source 1..21: mol_type = other RNA
gagaaccagaaacaatgccag

SEQ ID NO: 1646 - RNA, 21 nt, synthetic construct
  source 1..21: mol_type = other RNA
agcatggttgtctttgggtgc

We claim:

1. A double stranded ribonucleic acid (dsRNA) agent for inhibiting expression of complement component C3, or a salt thereof, wherein the dsRNA agent comprises a sense strand and an antisense strand forming a double stranded region, wherein each strand is no more than 30 nucleotides in length, wherein the sense strand comprises a nucleotide sequence comprising at least 17 contiguous nucleotides from the nucleotide sequence 5'-GAGCCGUUCUCUACAAUUACU-3' of SEQ ID NO:471, and the antisense strand comprises a nucleotide sequence comprising at least 17 contiguous nucleotides from the nucleotide sequence 5'-AGUAAUUGUAGAGAACGGCUCGG-3' of SEQ ID NO:496, and wherein one or more lipophilic moieties are conjugated to one or more internal positions on the sense strand.

2. The dsRNA agent, or salt thereof, of claim 1, wherein at least one nucleotide of the dsRNA agent comprises a nucleotide modification.

3. The dsRNA agent, or a salt thereof, of claim 2, wherein at least one of the nucleotide modifications is selected from the group consisting of a deoxy-nucleotide modification, a 3'-terminal deoxythymidine (dT) nucleotide modification, a 2'-O-methyl modified nucleotide modification, a 2'-fluoro modified nucleotide modification, a 2'-deoxy-modified nucleotide modification, a locked nucleotide modification, an unlocked nucleotide modification, a conformationally restricted nucleotide modification, a constrained ethyl nucleotide modification, an abasic nucleotide modification, a 2'-amino-nucleotide modification, a 2'-O-allyl nucleotide modification, 2'-C-alkyl-nucleotide modification, a 2'-methoxyethyl nucleotide modification, a 2'-O-alkyl nucleotide modification, a morpholino nucleotide modification, a phosphoramidate nucleotide modification, a non-natural base comprising nucleotide modification, a tetrahydropyran nucleotide modification, a 1,5-anhydrohexitol nucleotide modification, a cyclohexenyl nucleotide modification, a 5' phosphate or 5' phosphate mimic nucleotide modification, a vinyl phosphonate nucleotide modification, an adenosine-glycol nucleic acid (GNA) nucleotide modification, a thymidine-glycol nucleic acid (GNA) S-Isomer nucleotide modification, a 2-hydroxymethyl-tetrahydrofurane-5-phosphate nucleotide modification, a 2'-deoxythymidine-3'phosphate nucleotide modification, a 2'-deoxyguanosine-3'-phosphate nucleotide modification, and a nucleotide modification wherein a terminal nucleotide is linked to a cholesteryl derivative and a dodecanoic acid bisdecylamide group; and combinations thereof.

4. The dsRNA agent, or a salt thereof, of claim 3, further comprising at least one phosphorothioate internucleotide linkage.

5. The dsRNA agent, or a salt thereof, of claim 1, wherein the internal positions exclude a cleavage site region of the sense strand.

6. The dsRNA agent, or a salt thereof, of claim 1, wherein the one or more lipophilic moieties are conjugated to one or more of the internal positions selected from the group consisting of positions 5, 6, 7, 15, and 17 on the sense strand counting from the 5' end.

7. The dsRNA agent, or a salt thereof, of claim 1, wherein the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.

8. The dsRNA agent, or a salt thereof, of claim 1, wherein the lipophilic moiety is conjugated via a carrier that replaces one or more nucleotide(s) in the internal position(s) or the double stranded region.

9. The dsRNA agent, or a salt thereof, of claim 1, wherein the lipophilic moiety is conjugated to a nucleobase, sugar moiety, or internucleosidic linkage.

10. The dsRNA agent, or a salt thereof, of claim 1, further comprising a phosphate or phosphate mimic at the 5'-end of the antisense strand.

11. An isolated cell containing the dsRNA agent, or salt thereof, of claim 1.

12. A pharmaceutical composition for inhibiting expression of a gene encoding C3, comprising the dsRNA agent, or salt thereof, of claim 1.

13. A method of inhibiting expression of a complement component C3 gene in a cell, the method comprising:

(a) contacting the cell with the dsRNA agent, or salt thereof, of claim 1; and (b) maintaining the cell produced in step (a) for a time sufficient to obtain degradation of the mRNA transcript of the complement component C3 gene, thereby inhibiting expression of the complement component C3 gene in the cell.

14. A method of treating a subject diagnosed with a complement component C3-associated neurodegenerative disease, the method comprising administering to the subject a therapeutically effective amount of the dsRNA agent, or salt thereof, of claim 1, thereby treating the subject, wherein the complement component C3-associated neurodegenerative disease is selected from the group consisting of Alzheimer's disease (AD), Amyotrophic Lateral Sclerosis (ALS), schizophrenia, Parkinson's disease (PD), and Creutzfeldt-Jakob disease (CJD).

15. The method of claim 14, wherein the subject is human.

16. The method of claim 14, wherein the dsRNA agent, or salt thereof, is administered to the subject intrathecally.

17. A method of treating a subject having a disorder that would benefit from reduction in complement component C3 expression in an ocular tissue, comprising administering to the subject a therapeutically effective amount of the dsRNA agent, or salt thereof, of claim 1, thereby treating the subject having the disorder that would benefit from reduction in complement component C3 expression, wherein the disorder that would benefit from reduction in complement component C3 expression in an ocular tissue is selected from the group consisting of dry macular degeneration, wet macular degeneration, Basal Laminar drusen, diabetic retinopathy, diabetic macular edema, and retinal vein occlusion.

18. A kit comprising the dsRNA agent, or salt thereof, of claim 1.

* * * * *